United States Patent 11,739,335 (NUCLEIC ACIDS ENCODING CRISPR-ASSOCIATED PROTEINS AND USES THEREOF) - sequence listing, part 16

SEQ ID NO: 14425 - RNA, 3003 nt, Artificial Sequence
  Cas13d variant__Ruminococcus flavefaciens XPD3002__NLS-RfxCas13d-NLS-HA (CasRx)
augaguccuaaaaagaaaagaaaaguugaagcgucaauagagaaaaagaaaucauucgcaaaaggaauggguguaaaaaguaccuuaguaucuggcucaaaaguauauaugacgacauucgcagaaggaagcgacgcaagauuagagaaaauaguagaaggggacagcauuagaaguguaaacgaaggggaagccuuuagugcugaaauggcagacaaaaacgccggcuacaaaauaggcaacgcaaaauucagccacccgaaaggcuaugccguaguagcaaauaauccauuauauacaggaccuguacaacaagauaugcugggauuaaaagaaacacuagaaaaacgauacuucggcgaauccgcagaugguaaugacaauauaugcauucaagucauacauaacauucuagacauagagaaaauucuagcagaauacaucacaaacgcagcuuacgcaguaaauaacauaucgggacuagauaaagacauaauuggauucggaaaauuuucaacgguguacacuuacgacgaguucaaagauccugaacaccauagggcugcauucaacaauaacgauaaacuaauaaacgcaauaaaagcacaauacgaugaauuugacaacuuuuuagauaauccaagacuaggcuacuucggacaggcauucuuuucaaaagaaggcagaaauuauauuauaaauuacggaaacgaaugcuacgauauauuggcgcuacuaaguggacucagacacugggucguacacaacaaugaagaagaaucaagaauaucacgaacaugguuauauaaucucgacaaaaaucuggauaacgaauauauaucgacacuaaauuaccuauaugauagaauaaccaaugaacucacaaacagcuucagcaaaaauagugcagcaaacguaaacuacauagcagaaacauuagguauaaauccagcagaauuugcagaacaauauuuucguuucaguauaaugaaagaacagaaaaaccuaggauuuaauauaacaaaauuaagagaagucaugcucgacagaaaagacaugagugaaauaaggaaaaaucacaaaguauuugauagcauaagaacaaaaguauacacaaugauggauuuuguaauauaccgauacuacaucgaagaagacgcuaaagucgcggcugcgaauaaaucacuaccagauaacgaaaaauccuuaagugaaaaagacauauuuguaauaaacuuacgaggaucauuuaacgacgaccaaaaagaugcuuuauauuaugaugaagcaaauagaauauggaggaaauuagaaaauauaaugcacaauauaaaagaauuucgaggaaacaaaacaagagaauacaaaaagaaagaugcgccaagacuaccgaggauauuaccagcaggacgcgacguauccgcauucaguaaauuaauguaugcacuaaccauguucuuagacgggaaagaaaucaaugaucuauuaacaacucuaauaaauaaauuugacaacauccaaucauuucuaaaaguaaugccacuaauuggaguaaaugccaaauucguagaagaauaugccuucuucaaagacucagcaaagauugccgacgaauuaagacuaaucaaauccuucgcaagaaugggagaaccaaucgcagaugcacggcgagcaauguacauagacgcaauacgaauacuagguacaaaccuaagcuacgaugaauuaaaagcucuggcugacacuuucucacuagacgaaaacgguaacaaacuaaagaaaggaaaacauggcaugagaaacuucaucaucaacaacguaauaucgaacaaaagauuucauuaccuuaucagauacggagauccagcacaccuccaugaaauagccaaaaaugaagcaguaguaaaauucguccuagguaggauagcagauauacagaagaaacaagggcaaaacgguaaaaaccaaauagauagauauuaugaaacaugcaucggaaaagauaagggaaaaaguguuucagaaaaaguggaugcauuaaccaaaauaauaacagguaugaacuacgaucaauucgacaagaaaaggucgguaauagaagacaccggacgagaaaacgcagaacgagaaaaauucaagaaaauaauaucucuauaccugacaguaauauaucacaucuugaaaaauauaguuaacauaaacgcacgauacguaaucgguuuucacugcguagaaagagaugcacaacuauacaaagaaaaaggauaugauaucaaccucaagaaacuugaagaaaaaggauucuccuccguaacaaaacuaugcgcaggaauagaugaaacagcaccagacaaacgaaaagacguagaaaaagaaauggcagaacgagccaaagaaucaauagacucauuggaaagcgcaaauccaaaacuauaugcaaacuacauaaaauacagcgaugaaaagaaagcagaagaauuuacaagacaaaucaacagagaaaaagccaaaacugccuuaaacgcauaucuaagaaacacuaaauggaacguaauuauaagagaagaccuccuuagaauugacaacaaaacaugcacccuauucagaaauaaagcaguucaccuagaaguagcaagauaugugcacgcauacauaaacgacauagcagaaguuaauucauacuuucaauuauaucacuacauaaugcagcgcauaaucaugaacgaacgauacgagaaaaguucgggaaaaguaucagaauauuuugacgcaguuaaugacgaaaagaaauacaacgauagacuacuuaaacuauuauguguaccauucggguacugcauaccucgcuucaaaaauuuaagcauagaagcccucuuugaucgaaaugaagccgccaaauucgauaaagagaaaaagaaaguaucugguaacucaggaucaggaccgaagaagaaaagaaaaguagcggcagccuacccauacgaugucccagauuacgcguga

SEQ ID NO: 14426 - RNA, 3003 nt, Artificial Sequence
  Cas13d variant__Ruminococcus flavefaciens XPD3002__NLS-dRfxCas13d-NLS-HA (dCasRx)
augucaccaaaaaaaaaaagaaaaguagaagcaucuauagaaaaaaaaaaaagcuucgcaaaagguaugggagucaaaagcacacuaguaagcggaucaaagguauacaugacaacauucgccgaagggucagacgcaagacuagaaaaaaucguagaaggagacucgaucagaucaguuaacgaaggcgaagcauucucagcugaaauggcagacaaaaacgcaggauauaaaaucggaaacgcaaaauuuagucacccuaaaggauacgcaguaguagccaauaacccccuauacacuggcccaguacaacaggauauguuaggacuaaaagaaacuuuagaaaaaagauacuuuggugaaucugccgacggaaacgacaauauuugcauucaaguaauacauaauauacuagauauagaaaaaaucuuagccgaauacaucacaaacgcagccuacgcaguaaacaacauaagcggacuagacaaagacauaauaggauuuggaaaauucuccacaguauacacauaugacgaauucaaagacccagaacaucaccgagcagccuuuaauaacaaugauaaacuaauuaaugcaauaaaagcacaauaugaugaauucgacaauuuccuggacaauccacgacuaggauauuucggacaagccuucuuuagcaaagaaggaagaaacuacauaaucaacuacggcaacgaaugcuacgacauacuagcauuauuaagcggacuagcacauuggguagucgcaaacaaugaagaagagucacgaauuucaagaacaugguuauacaaccucgauaaaaacuuagauaacgaauacaucaguacucuuaacuaccuauaugauagaauaacaaaugaacuuacaaacucauucaguaaaaacucggcggccaauguaaacuacauugcugaaacccucggaaucaacccagcagaauuugcagagcaauauuuccgauuuucgauaaugaaagagcaaaaaaacuugggauucaacauuacaaaacucagagaaguaaugcuagaucgaaaagauaugucugaaauaagaaaaaaccacaaaguauucgacucaauaagaacuaaaguauacacaaugauggauuucgucauuuauagauauuauauagaggaagacgcaaaaguagcugccgcaaacaaaaguuuaccugauaacgagaaaagccuaucugaaaaggacauuuuugugaucaacuugagagggucuuuuaacgaugaucaaaaagacgcauuauauuacgaugaggcaaacagaauauggaggaaacucgaaaacauaaugcacaauauaaaagaauuuagaggcaacaaaacaagagaauauaaaaaaaaagacgcaccuagacuaccacgaauccuuccugcuggaagagacguaagcgcauuuucuaaguuaauguacgcacuaaccauguucuuagacgguaaagagauaaacgacuuauuaaccacacuuauuaauaaauucgacaauauucaauccuuucuaaaaguaaugccccuaauaggcguaaacgcgaaauucgucgaagaauacgcauucuucaaagauagugcgaagauagccgaugaacuacggcuuauaaaaagcuuugccagaaugggagaacccaucgcugaugcacgaagagccauguauauagaugcaauaagaauacuaggaacuaaccuuucauacgacgaauuaaaagcucuagcagacacuuucagccuagacgaaaauggaaacaaacuaaagaaaggaaaacacgguaugcggaacuuuauaauaaauaacguaauuuccaauaaacgauuccauuacuuaauccguuacggagacccagcacacuuacacgaaauagcaaaaaacgaagcaguaguaaaauucguauuagguagaauagcggauauucaaaaaaaacaaggacaaaacggaaaaaaucaaauagacagauacuacgaaacgugcauaggaaaagacaaaggcaaaagcguaucagaaaaaguagacgcauuaacaaaaauuaucacaggaaugaauuaugaucaauucgauaaaaaaagaagcgucauagaagacacgggaagagaaaacgcagaaagagaaaaauuuaaaaaaauaauaucauuguaccucaccguaauauaccacauauuaaaaaauauugucaacauuaacgcaagguauguaauaggauuucacuguguagaacgggacgcccaauuauauaaagaaaaggguuaugauauaaaccuaaagaagcuagaagaaaaagguuuuagcaguguaacaaaauugugugcaggaauagacgaaacagcaccugauaaacgaaaagauguugaaaaagaaauggcagaaagagcaaaagaauccauugacucacuagaaagcgcaaauccgaaacuuuaugcaaacuacauaaaauauucagacgaaaaaaaagcagaggaauuuacacgacaaauuaaccgcgagaaagcaaaaacagcacuaaacgcauaccugcgaaauacaaaauggaaugucaucauuagagaagaucuauuacgaauugacaacaagacguguacauuauucgcaaacaaagcagucgcacuagaagucgccagauacgugcacgcauauauuaaugauauagcagaaguaaacuccuauuuccaauuguaucauuacaucaugcaaagaauaauaaugaacgagagauaugaaaaaucaagcgguaaaguaucagaauauuuugaugcaguuaaugacgaaaaaaaauauaaugauagauuacuuaaauuauuauguguuccuuucggauauuguauaccaagguucaaaaacuuaucgauagaagcuuuauucgauagaaaugaagcagcaaaguucgacaaagaaaaaaaaaaaguaagcgguaacagcggcuccggacccaaaaaaaaaagaaaaguagcggcggcauacccuuaugauguacccgacuaugcauga

SEQ ID NO: 14427 - RNA, 3381 nt, Artificial Sequence
  Cas13d variant__Ruminococcus flavefaciens XPD3002__hnRNPa1-dCasRx-HA
augggaagaaguggcaguggaaauuuuggaggaggacgagguggaggauuuggaggaaacgacaacuuugguagaggcggcaacuucaguggaagagguggcuucggaggauccagaggaggcggaggauauggaggcaguggagaugguuauaauggguucggaaacgauggcucaaauuucggagguggaggaucauacaacgacuuuggaaacuacaacaaucaaucaucgaacuuuggcccaaugaaaggaggcaauuuugguggaagaucaucagggccauauggaggaggggggcaauauuucgcaaaacccagaaaucagggaggauauggaggauccagcucgucaaguucauauggaucagguagaagauuuaguccuaaaaaaaaaagaaagguugaagccucuauagaaaaaaagaaaagcuucgcuaaaggaaugggagucaaaaguacacuaguaagcggcucgaagguauacaugacuacguucgcugagggcuccgaugcccgauuggaaaaaauaguagaaggagauaguauaagguccgugaacgaaggagaggcguuuucagcagaaauggcagacaagaacgcaggauacaaaauagguaaugcaaaauucagccauccaaaagguuacgcuguaguagcaaacaauccacuuuauacagggccaguccaacaagauaugcuuggacuuaaagaaaccuuagaaaaaagauauuuuggagaaucagcugauggaaacgauaacauauguauacaagucauccacaacauacuugacauagaaaaaaucuuagcagaauacauaacuaaugcagcauaugcagucaacaauauuucagggcuagacaaagauauuauaggauuuggaaaauuuucaacaguauacacauacgacgaauuuaaagaucccgagcaccacagagcagcauuuaacaacaaugacaaauuaauaaacgcaaucaaagcccaauaugacgaauuugacaauuuccuagacaauccaagauuagguuauuucggacaggcauuuuuuucaaaagaaggaagaaauuacauuaucaauuauggcaaugaaugcuacgauaucuuagcacuauugucaggacuagcgcauuggguggucgcaaauaacgaagaagagagcagaauaaguagaacaugguuauacaaccuagauaagaaucuagauaacgaguauauaucaacacuaaacuauuuauaugauagaauaacaaaugaacuaacaaauucauuuaguaaaaauucagcagcaaacguaaacuauauugccgaaacacuugguauaaauccagccgaauuugccgaacaauauuucagguuuucaaucaugaaagaacaaaaaaauuuaggauuuaauauuacaaaacucagggaaguuauguuagacaggaaggauaugagugagauaaggaaaaaccauaaaguauucgacuccauuagaacaaaaguauacacaaugauggauuucguaaucuauagauauuacaucgaggaagaugcaaaagucgcagccgcaaacaagucuuuaccugauaacgaaaaaagcuuaucagaaaaagacaucuuuguuauuaauuuaagagggucguuuaaugaugaucaaaaagacgcuuuauauuaugaugaagcaaauagaauauggcgaaaacuagaaaacaucaugcacaacauaaaagaauuuagaggaaacaaaacgcgagaauauaaaaagaaagacgccccaagacucccaagaauuuuaccugccgguagggauguaucggccuuuaguaaacuaauguaugccuuaacaauguuuuuagaugggaaggaaauuaacgaucuacuaacaacauuaauaaacaaguuugauaacauucaaucauuuuuaaaaguaaugccucucauaggcguaaaugcaaaauucguagaagaauacgcauuuuucaaagauucagcaaaaauagcggacgaauuacgauuaaucaaaagcuucgccagaaugggagaaccaauagcagaugcccgaagagcaauguacauagacgcaaucagaauauuagguacuaaccuaaguuaugaugaauuaaaagcauuagcggacacauuuagucuagaugagaaugguaauaaacucaaaaaaggcaaacacggaaugcgaaauuuuauaaucaauaacgucauaucaaauaaaagauuccauuauuuaauaagauacggagacccagcacacuuacacgagauagcgaagaacgaagcugucguaaaauuuguauuaggacgcauugccgacauacaaaaaaaacagggccaaaacggaaaaaaucaaauagauagauauuaugaaacauguaucggaaaagacaaaggcaagagcguaagugaaaaagucgaugcacuaacaaaaaucauuacaggaaugaauuaugaucaauuugacaaaaaacgaucaguaaucgaagacacugggagggaaaaugccgaacgagaaaaauuuaaaaaaauuauaucacucuaucuaaccguaauauaucauauuuuaaaaaauauagucaacauaaaugcacguuacguaauaggauuucauuguguagaaagagaugcccaauuauauaaagaaaaaggauacgauauaaaccuaaaaaaacucgaggaaaaaggauucaguucaguaacuaaacuuugcgcugggaucgacgaaacagcuccagauaaaagaaaagauguagaaaaagaaauggcugaaagagcuaaagaauccaucgacucacuggaguccgccaauccaaaacuauacgccaauuacauaaaauauucagaugaaaaaaaagcagaagaauucacacgacagauaaauagagaaaaggcuaaaacagcauuaaaugcuuaccuaagaaacacaaaauggaacgucauaauaagagaagaccuguuaagaaucgacaacaaaacguguacacucuuugcuaacaaagcaguggcauuagagguagcgagauauguacaugcuuauauuaaugacauagcugagguaaacucuuauuuucaauuauaucauuauauaaugcaacgaauaauaaugaaugaaagauaugaaaaaaguucagguaaaguuagcgaauauuuugacgcaguaaaugacgaaaaaaaguauaacgacagacuccuaaaauugcuaugugucccauuuggcuacuguaucccaagguuuaaaaacuuaagcaucgaagcacucuuugauagaaaugaagccgccaaauucgacaaagagaaaaaaaaaguaaguggaaacucagggagcggaccgaaaaaaaaaagaaaaguagcggccgcuuauccuuacgacguaccagacuacgcauga

SEQ ID NO: 14428 - RNA, 2787 nt, Artificial Sequence
  Cas13d variant__Uncultured Ruminococcus sp. __UrCas13d-HA
auggcaaaaaaaaacaaaaugaaaccacgagaacuaagagaagcacaaaaaaaagcgcgacaauuaaaagcagcagaaauuaacaauaacgcagccccugcaauagccgcaaugccagcagcagaaguaauagcaccagcggcugaaaaaaaaaaaagcagcguaaaagcagcaggcaugaaaagcaucuuagugucagaaaauaagauguauaucacuuccuuuggaaaagggaacucagcaguauuagaauacgaaguugacaacaacgacuauaaucaaacucaauuaucaaguaaagauaacucaaacauacaacugggcggggucaaugaaguaaacauaacuuuuucaucaaagcacggauucgaauccggagucgaaauaaacacaucaaacccaacccaucgcagcggagaaucaucccccgucagaggagauauguuaggacuuaaaucagaacuagaaaaaagguuuuuugggaaaacguucgacgacaauauacacauacaauuaauauauaauauccucgauauagaaaaaaucuuagcaguauacguuacuaacaucguauaugcacuuaacaacauguuaggagucaaaggaucugagucacacgacgacuucauaggcuaccuaucaaccaacaauauauacgacguauucaucgaucccgauaauuccucacuaucagaugacaaaaaagccaacguacgaaaaucacuaucaaaauucaaugcauuacuaaaaacuaaaagauuaggauacuucggauuagaagaaccaaagacaaaagacaacagaguaagccaagcauacaaaaaacguguauaccacauguuagcuauaguaggucaaauaagacaaugcgucuuccacgacaaaucaggcgcaaaaagauuugaccuauauagcuuuaucaacaauauagauccagaauauagagauacacuagacuacuugguagaagaaagacugaaaucaauaaacaaggacuucauagaagauaacaaagucaacauaagcuuacucauugacaugaugaaaggauaugaagcagacgauaucauacgauuauauuacgacuuuauaguccuaaaaucucaaaaaaaucuaggauucagcauaaaaaaacuaagagaaaaaaugcucgacgaauacggcuuuagauucaaagacaaacaauaugauucagucagaaguaaaauguacaaacuaauggacuucuuauuauuuuguaacuacuacagaaaugacauagcugccggagaaaguuuaguaagaaaacuaagauuuaguaugacagaugacgaaaaggaagguauauaugccgacgaagcagcuaaacuauggggcaaauuuagaaacgauuucgaaaauauugccgaccacaugaauggagauguuauuaaagaacuagguaaagcugacauggacuuugaugaaaaaauacuggacucagaaaaaaaaaacgccucugacuuauuauacuucucaaaaaugauauacaugcuaacguacuucuuagaugggaaagagauuaaugaccucuuaaccacguuaauuaguaaauuugauaacauaaaagaauuccuaaaaauaaugaaaagcucagccguugacgucgaaugugaacuaacagcaggauacaaacuuuuuaacgacucgcaaagaaucacaaaugaauuguucauaguaaaaaacauugccucaaugagaaaaccagcagccuccgcaaaacuaacaauguuucgagaugcacuuacaauacucggaauagacgacaagauaacagaugacagaauaaguggaaucuuaaaacuaaaagaaaaaggaaaaggaauacacggcuugagaaacuuuauaaccaacaacgucauagaauccagccgauucguauauuuaauaaaguacgcaaacgcccaaaaaauaagagaaguagcaaaaaacgaaaaggucguuauguucgugcuaggaggcauaccugauacacaaaucgaaagauauuacaagucauguguugaauuuccugauaugaacucuagccuaggaguaaaaagaucugaauuagccagaaugauaaaaaacauuaguuuugacgauuucaaaaacgugaaacaacaagcgaaaggaagagaaaacguagcaaaagaacgagccaaagcaguaauaggacuuuauuuaacugucauguaucuacuaguuaaaaauuuaguaaacgucaacgcuagauacguaauagccauacacugucuagaacgcgauuucggucuauacaaagaaauuauaccagaacuagcuagcaaaaaccuaaaaaacgacuaccggauacugagccaaacauuaugugaacuaugugacaaaucaccaaauuuauuccugaaaaaaaacgaaagauuaagaaaauguguagaaguggacauaaauaaugccgacaguaguaugacaagaaaauauagaaauugcauagcucacuuaacugucguaagagaauuaaaggaauacaucggagauauauguacagucgacagcuauuuuucuauauaucacuauguaaugcaacgaugcauaacaaaaagagaaaaugauacaaaacaggaagaaaaaauaaaauacgaagaugacuuacucaaaaaucacggguacacaaaagauuuuguaaaagccuuaaacucacccuuuggauacaacauaccacgauucaaaaacuuaagcaucgaacaacuguucgaucgaaacgaauaucuuacagaaaaguacccguaugacguccccgauuaugcauga

SEQ ID NO: 14429 - RNA, 2787 nt, Artificial Sequence
  Cas13d variant__Uncultured Ruminococcus sp. __dUrCas13d-HA
auggcaaaaaaaaauaaaaugaaaccacgugaacucagggaagcacaaaaaaaagcuagacaacuuaaagcagcggaaauaaauaauaaugccgcaccugcuaucgcagcaaugcccgcggcagaagucauagcaccugcugcugaaaaaaaaaaaucaagcguaaaagcggcaggaaugaaaucaauacuaguaagcgagaacaaaauguauaucacaaguuucggaaaaggaaacagugcgguauuagaauaugaagucgauaacaacgacuauaaucaaacacaacuaagcucaaaagacaacucaaacauacaacuuggaggagucaacgaaguaaacauaacauuuucuaguaaacauggauuugaaucaggagucgaaauaaacacaagcaacccaacacauagaaguggugaauccucgccaguaagaggugacaugcugggucugaaaagugaauuggaaaaaagauucuuuggaaaaacauucgaugacaacauacacauacaacuaauauacaacauccuagacauagaaaaaauucuagcgguauacgucacaaauauaguguacgcauuaaacaacaugcuaggaguaaaagggagugaaucacacgaugauuuuauaggauacuuaucgacaaauaauaucuaugauguauuuauagacccagacaacucaucuuuaucagaugacaaaaaagcaaacguuagaaaaagccuaaguaaauuuaaugcacuccuaaaaacuaaaagacugggcuacuucggccuugaagaaccaaaaaccaaagauaaucgcguaucacaagcuuacaaaaaacggguuuaucauaugcuagccauagucggacaaauagcucaaugcguauucgccgacaaaucaggcgcaaagagauuugaucuuuacuccuucauaaauaacauagacccagaguacagggacacauuagacuauuuaguagaagagcgauugaaauccauuaauaaagauuucauagaagauaacaaaguaaauauaucauuauuaaucgacaugaugaaagguuacgaagcggacgauauuauacgccuauauuacgacuuuauaguacuuaaaucacaaaaaaaccuaggauucaguauaaaaaaacuucgagagaaaaugcuggaugaauacggauucagauucaaagacaaacaauacgacucaguaagaagcaaaauguauaagcucauggacuuucuacuauucugcaauuacuauaggaacgacauagcagcuggagaaucccuuguuagaaaacuaagauucaguaugacagacgaugaaaaagaagggauauacgccgacgaagcagccaagcuauggggaaaauucagaaaugacuuugaaaauauagcagaccauaugaacggagaugucaucaaggaacuaggaaaagcagacauggauuuugaugaaaaaauauuagauucugaaaaaaaaaacgcaucagacuugcuauacuucucaaaaaugaucuacaugcucacuuacuuuuuagacggaaaggaaaucaaugaucuguuaacaacccuaaucaguaaauucgacaauauaaaagaauucuuaaaaauuaugaaaucaagugcaguagacguagaaugugaacuaacagcaggauacaaacuauuuaaugauucucagcgaauaacaaacgaacuauuuaucguaaaaaacauugcauccaugagaaaacccgcagccucagcaaagcuaacaauguuucgagacgcauuaacaauauuaggaaucgacgauaaaauuacugacgacaggauaucagguauacucaaauuaaaagaaaaaggaaaaggaauccauggacuaagaaauuucauaacaaauaauguaauagaaucuucaagguucguauacuugaucaaauacgcuaaugcccaaaaaaucagagaagucgcaaaaaacgaaaaagucguaauguuuguauuaggcggcauaccagauacacagauugaaagauacuacaaaucaugcguagaauuuccagacaugaacucaagcuuaggaguaaaaagaagugaacuagcccgaaugauaaagaauauaaguuuugacgauuuuaaaaacguaaaacaacaagcaaaaggacgagagaauguagcaaaagaaagagccaaagcaguaauaggauuauacuuaacgguaauguacuuacugguaaaaaauuuaguaaacguaaacgcccgauauguaauagccauacacugccuugagcgagauuuuggacuauacaaagaaaucauaccagagcucgcaagcaaaaaccuaaaaaaugauuacagaauacuaucgcaaacauuaugcgaauuaugugacaaaucaccuaaucuauuucuaaaaaaaaacgaaagacuaagaaaauguguggaaguagauauuaacaacgccgauucaagcaugacaaggaaauaugcaaauugcaucgcugccuuaacaguuguacgagaguuaaaagaguauaucggagauauauguacuguagauuccuacuucucaauauaucacuauguaaugcaacguugcauaacaaaaagagaaaacgacacaaaacaagaagaaaagauaaaauaugaagaugacuuacuaaaaaaucauggauacacaaaagacuuuguaaaagccuuaaauucaccauucggcuauaauauaccuagguucaaaaaucuaucaauagaacaauuauucgaccgaaacgaguaccuaacagaaaaauacccauacgauguacccgauuaugcauga

SEQ ID NO: 14430 - RNA, 2859 nt, Artificial Sequence
  Cas13d variant__Uncultured Ruminococcus sp. __NLS-UrCas13d-NLS-HA
augucacccaaaaaaaaacgaaaaguagaagcaagcgccaaaaaaaauaaaaugaaaccccgagaacuacgagaggcacaaaaaaaagccagacaauuaaaagcagccgaaauuaacaauaacgccgccccagcaauagcagcgaugccagccgccgaaguuaucgcaccagcugcagaaaaaaaaaaaucaagcguaaaagcagcagggaugaaaucaauucuagugucagaaaacaaaauguauauaacuagcuuuggcaaaggaaauucagccguauuagaauacgaagucgauaacaaugacuacaaccagacccaacuaucaucuaaagauaauagcaacauacaacucggaggcguaaacgaaguaaacauaacauucucauccaagcauggguuugaauccggaguagaaauaaauacaagcaauccaacacacagaucaggagaaucaagcccaguacgaggcgacaugcugggacuaaaaucugagcuggaaaaaagauuuuucggaaaaacauucgacgacaauauacauauccaacucauauauaacauacuagauauugaaaaaauucuugcaguauaugugacaaauauaguauacgcacuaaauaacaugcuaggagucaaagguuccgaaagucacgacgacuuuaucggcuaccuaucaacaaacaacauauacgacguuuuuaucgacccagauaauucaucauuaagugaugauaaaaaggcaaacguaagaaaaucacuaucaaaauucaacgcauuacugaaaacaaaaagauuaggguauuucggauuagaagaaccaaaaaccaaagauaacagaguuucucaagcuuacaaaaaaagaguauaccacaugcuagcgaucgucggccaaauuaggcaaugcgucuuccacgacaaaucuggugcaaaaagauucgaucuauacucauuuauuaauaauauagacccagaauaccgagauacacuugauuaccugguugaggaaagacuuaaaucaauaaacaaagacuucauagaagauaauaaaguaaacaucucccuacuaauagacaugaugaaaggguacgaagcagaugacauaauaagacuuuacuaugacuucauaguucucaaaucacaaaaaaaccucggauucucaauaaagaaacuacgcgaaaaaaugcuggacgaauauggauuccgauucaaagacaaacaauaugacucagugcgaucaaaaauguacaaauuaauggauuuccuacuuuucugcaacuauuacagaaacgauaucgcagcaggagaaucgcuaguacgaaaauuacgauuuagcaugacagaugaugagaaggaaggaauauaugcagacgaagcagcaaaacuauggggaaaauucagaaacgauuuugaaaacauugcagaccacaugaacggcgacguaauaaaagaacuaggaaaagcggacauggauuucgaugaaaaaauacuagauuccgaaaaaaaaaaugcaagugaucuccuuuauuucucaaaaaugauuuacaugcucacauacuuccucgauggaaaagaaauaaaugaccuauuaaccacacuuauaucaaaauucgauaauauuaaggaauuccuaaaaauaaugaaaagcucagcaguagacguagagugugaauuaacagccgguuacaaacuauuuaaugauagccaaagaauaacaaacgaacucuucauaguaaaaaacauagcuucaaugcgcaaaccugccgcaucagcaaaauuaacuauguuuagagaugcacuaaccauacuaggaauagacgacaaaaucacagacgacagaauaagcggaauauugaaauuaaaagagaaagguaaaggcauacacggacucaggaauuuuauaacaaauaauguaaucgaaucaagcagguucguauaccucauuaaauaugccaacgcacaaaagauacgagagguagcaaaaaaugagaaagugguaauguucguacuagguggaauaccagacacacaaauagaacgauacuacaaaaguuguguagaauucccugauaugaacucaagcuugggaguuaaacggucagaacuugccagaaugauaaaaaacaucagcuucgacgacuuuaaaaacguaaaacaacaagcgaaagggcgagaaaacguugcuaaggaaagagcaaaagcaguuauaggacuauaucugacagugauguauuuacuugucaaaaauuuaguaaacguaaacgcaagauacguuauagcaauucauugccuagaacgagauuuuggccuauacaaagaaauaauucccgaacucgcaucaaaaaaccuaaaaaaugauuacagaauauuaagucaaacauuaugcgaacuaugcgauaaaucaccaaacuuauuuuuaaaaaaaaaugaaagauuaagaaaaugcguagaaguggacauaaauaacgcagacucauccaugacacgaaaauauagaaacugcauagcacaccuaacuguaguaagagaacuaaaagaauacauaggagauaucugcacugucgacucauauuucucuauauaccauuaugucaugcaaagauguauaaccaagcgcgaaaaugacaccaaacaagaagaaaagauaaaauacgaggaugaucuacugaaaaaccauggauacacaaaagacuuugucaaagcucuuaauagccccuuuggauacaacauaccaagauuuaaaaauuuaucaaucgaacaauuauuugacagaaaugaauaucucacagaaaaaggcucaggucccaaaaaaaaaagaaaaguagcagcugcauaccccuaugauguaccagacuacgcguga

SEQ ID NO: 14431 - RNA, 2859 nt, Artificial Sequence
  Cas13d variant__Uncultured Ruminococcus sp. __NLS-dUrCas13d-NLS-HA
augucaccaaaaaaaaaacgcaaaguugaagcaucagcaaaaaaaaacaaaaugaaaccgagagaacucagggaagcccaaaaaaaagcaagacaauuaaaggcagcagaaauuaacaauaaugcagcuccugcaauugcagcaaugccagcagcagaaguaauagcacccgcagcagaaaaaaaaaaaucauccgucaaagcugcagguaugaaaaguauuuuaguaucagaaaacaaaauguacauuacuuccuucggaaaaggaaauucugcaguacuagaauacgaaguagacaacaaugauuauaaccaaacucagcuaagcuccaaagacaacucaaacauacagcuaggugggguuaacgaaguaaauauaacauucucuucaaaacaugguuuugaaucaggagucgaaauuaauacaaguaacccaacccaucgauccggagagagcagcccaguaaggggcgacaugcuaggacucaaaagugaacucgaaaaacgcuucuuuggaaaaacuuucgacgauaacauacacauacaacuaaucuauaacauacuagauauagaaaaaaucuuggcaguauaugugacgaacaucguguacgcacucaauaacaugcucggcguaaaaggcagcgaaucccacgacgacuucaucggauaucucuccacaaacaacaucuaugauguauucauagauccagauaacucaucacuaucagaugacaaaaaagcaaauguaagaaaaaguuuaucgaaauucaacgcacuguugaaaacuaaaagauuaggcuauuucggacuagaagaaccaaaaacaaaagauaauagagucagccaggcauacaaaaaaagaguauaucauaugcuugcaaucguaggacaaauugcacaauguguuuucgccgacaaaaguggagcgaaaagguucgaucuauauucauuuauaaacaauauugacccagaauauagggacacauuagacuaccuugucgaagaacgacuuaaaagcauaaacaaagauuucaucgaagacaauaaaguaaacauuaguuuacuuauugacaugaugaagggauacgaagccgacgauaucauaagauuauauuacgacuucauaguauuaaaaucacaaaaaaacuuaggauucagcauaaaaaaacuacgagaaaaaauguuagacgaauacgguuuuagauucaaagacaaacaauacgacuccguaagaucaaaaauguauaaacuaauggauuuccuacuauuuugcaacuacuacaggaaugauauagcugcaggggaaucuuuaguucgaaaacuaagauucagcaugacagacgaugaaaaagaaggaauauaugccgaugaagcagcuaaacuaugggggaaauucagaaaugauuucgaaaauaucgcagaccacaugaauggagacguuauaaaagaacugggaaaagccgacauggauuucgacgaaaagauauuagacucagaaaaaaaaaaugcaagugaucuucuauauuucagcaagaugaucuacaugcuaaccuacuucuuagacgguaaagaaauaaaugacuuacuaacaacacuaaucucuaaauucgacaacaucaaagaauuuuuaaaaauaaugaaaucgagcgcgguagacguugaaugcgaguuaacggcaggauauaaacucuuuaacgauagucaaagaauaacaaacgaacuauuuaucguaaaaaacauugccucaaugagaaaaccggcugcgucagcaaaacuaacaauguuccgagacgcacuaacaauauugggaauagaugauaaaauaacagacgauagaauauccgguauacuaaaacuuaaagagaaaggaaaagguauacauggacuaagaaauuuuauuacaaacaauguaauugaaucaagccgauucguauaccuuauaaaauaugcgaacgcacaaaaaauccgagaggucgcaaaaaacgaaaaaguaguaauguucguucuuggaggcaucccagacacccaaauagaaagauacuauaaaagcuguguagaauucccagauaugaacucaucgcuaggcgucaagcgaagugaauuagcuagaaugauaaaaaacauaucauucgaugacuucaaaaacgugaaacaacaagcaaaaggaagagaaaacguagcaaaagaacgagcaaaagcaguaauaggucuuuaccuaacaguaauguaccuccucguaaaaaauuuaguuaauguaaacgcuagauauguaauagcgauacauugcuuagaaagagacuucggacuguacaaagaaauuauacccgaauuagcaagcaaaaaucucaaaaacgacuacagaauacucucacaaacacuaugugaacucugcgacaaaaguccuaacuuauuccucaaaaaaaacgagcguuuaagaaaaugcguagaaguagauauaaacaacgcagacucaagcaugacaaggaaauaugcaaauugcauagcugccuuaacaguaguuagagaauuaaaagaauauaucggugauauaugcacagucgauucauauuuuucaauauaccacuauguaaugcaacgaugcauaacaaaaagagaaaaugauacaaaacaagaagaaaaaauaaaauacgaagacgauuuauuaaaaaaccacgguuauacuaaagauuucguaaaagcccuaaacucgccauucggauacaacauaccacgauucaaaaaucuuucaauugaacaacuauucgaccggaacgaauaccucacagaaaagggauccggacccaaaaaaaaaagaaaaguagcagcagccuauccauaugauguaccugauuacgcauga

SEQ ID NO: 14432 - RNA, 4275 nt, Artificial Sequence
  Cas13d variant__Leptotrichia wadei __NLS-LwCas13a-msfGFP
augaaaagacccgcagcuaccaagaaagcaggacaagcuaaaaagaagaaaggaucuaugaaaguaacuaaagucgacggaaucagucauaagaaauacauagaagaaggcaaacucgugaaaucgaccagcgaagaaaacagaacaucagaaagacuauccgaauuacuauccauacgacuagacaucuauaucaaaaauccagauaacgcaucagaagaagaaaacagaauaagaagagaaaacuuaaagaaauucuucuccaacaaaguccuacaccuaaaggacucaguucuauaucuuaaaaaucgaaaagagaaaaacgcagugcaagacaaaaauuacagugaagaagauaucagcgaauaugaccucaaaaauaaaaauagcuuuuccguacuaaagaaaauacuuuuaaaugaagauguuaauucggaagaauuagaaauauuucggaaagacguggaagcaaaacugaacaaaauaaacagucuaaaauauucauucgaagaaaacaaagcaaacuaucagaaaauaaacgaaaauaacguagaaaaagucggagggaaaucuaaacgaaacauaaucuaugauuacuaccgugaauccgccaaacgcaaugacuacauaaacaacguacaagaagcauuugacaaacuauauaagaaagaagacaucgaaaaacuauucuuucuaauugaaaauucgaagaaacacgaaaaauauaaaauaagggaguauuaucacaaaauuauugggagaaagaacgauaaagaaaacuucgccaaaaucauauaugaagaaauucaaaauguaaauaauauaaaagaauugauagagaaaauuccugauaugagugaacucaagaaaucccaaguauuuuacaaauauuaccuagacaaagaagaauuaaaugacaaaaacauaaaauacgcuuucugucauuucguagaaauagaaaugucacaauuacuuaaaaacuacgucuauaaaagauuaaguaacauaucaaaugacaaaauaaaaagaauauucgaauaccaaaacuuaaagaaacuaaucgaaaacaaacuacuaaacaaacuagacacuuacgugagaaauugcggaaaauacaacuauuauuuacaaguaggggaaauagcaacaagugauuucaucgcacgaaaucgacaaaaugaggcuuuucucagaaacauuauaggaguaaguucaguagcauacuucucacuacgaaauauacuagaaacggaaaacgaaaauggaauaaccggccgcaugcgaggaaaaacagucaaaaacaacaaaggcgaagaaaaauacguaucaggagaaguagacaaaauauauaaugaaaacaaacaaaacgaagucaaagaaaauuuaaaaauguuuuauucguacgauuucaauauggauaacaaaaacgaaauagaagacuucuuugcaaacauagaugaagcaauaaguuccauaagacacggcauaguacacuuuaaccuggaauuagaaggaaaagacaucuucgcauucaaaaacauagcaccaucagaaauuagcaagaaaauguuucaaaaugaaaucaaugaaaagaaauugaaauuaaaaauauuuaaacaacuaaauucagcaaacguguucaauuacuaugaaaaagauguuauuaucaaauaucucaaaaacacaaaauucaacuucguaaauaaaaacauccccuuuguaccuaguuucacuaaacuguacaauaaaauagaagacuuacgaaauacacuaaaauucuucuggucgguaccaaaagauaaagaagaaaaagaugcgcaaauuuaccuccucaaaaauauauauuacggugaguucuuaaacaaauuugugaaaaacuccaaagucuucuuuaaaaucacaaaugaaguaaucaaaauaaauaaacaacgaaaccagaaaacuggacauuauaaauaucaaaaauuugaaaauauagaaaagacaguacccguagaauaucuggccauaauccaaucacgugaaaugauaaacaaccaagauaaagaagagaaaaacacauauaucgacuucauacaacagauauuuuuaaaaggguucauagauuacuuaaauaaaaacaauuuaaaauacauagaaagcaacaauaauaaugacaacaacgacauauucucaaaaauaaaaauuaagaaagacaauaaagaaaaauaugacaaaauccucaaaaauuacgaaaaacacaaccgcaauaaagaaauaccacacgaaaucaaugaguucguacgggaaauuaaacuaggaaaaauauuaaaauacaccgaaaaccucaauauguuuuacuuaauacucaaacuacugaaccacaaagaacuuacaaaucucaaaggaagucuagaaaaauaccaaucggcaaauaaagaagaaacauucucagaugaacuagaauuaauaaacuuacuaaacuuagacaacaaccgaguaacagaagacuucgaacuugaagcaaacgaaauaggcaaauucuuggauuuuaacgaaaacaaaauaaaagauagaaaagaauugaagaaauuugacacaaacaaaaucuacuuugauggagaaaauaucaucaaacaccgugcauucuacaacaucaagaaauacggaaugcucaaccuucuagagaaaauagcagauaaagccaaauacaaaauaucacuuaaagaacuaaaagaauauagcaacaagaaaaaugaaauagagaaaaauuacaccaugcaacaaaacuugcaccggaaauaugcacguccuaagaaagaugaaaaauuuaaugacgaagacuauaaagaauaugaaaaagccauagguaauauacaaaaauauacacaccugaaaaauaaaguugaguucaacgaacuaaaccuacuccaaggucuacuacuaaaaauacuacacagacuugugggguauacaucaauaugggaaagggaccuacgcuuccgguuaaaaggcgaauuuccugaaaaucacuacauagaagaaauauucaauuucgauaauucaaagaacguaaaauauaagucaggucaaauagucgaaaaguauauaaacuucuauaaagaacuauacaaagacaacguggagaaaaggucaauuuacagcgacaagaaagucaagaaauuaaaacaagagaagaaagaccuauacauacguaacuacauagcgcacuuuaauuauauuccgcacgcggaaauaucacuucuugaaguacuggaaaaucuuaggaaauuauuaucauaugaucguaaacucaaaaaugccauaaugaaaucaaucguagacauccuaaaggaauauggauuuguggcaacguuuaaaauaggagccgauaaaaagauagaaauccaaacccuagaaagcgagaaaauaguucacuugaaaaaccuaaagaagaagaaacuaaugacagaccgaaauagugaagaacugugcgagcuaguaaaaguaauguucgaguacaaagcacuagaaggcggaggaggaucuggaggagguggauccggcggcggaggauccguauccaaaggcgaagaacuauucacggguguagugccaauauuaguagagcuagauggagacgugaaugggcauaaauucucaguccgaggagagggagaaggcgacgcaacuaacggcaaacuaacgcucaaauuuaucugcacaacagguaaacuacccguaccauggccaacacugguaaccacccuaacauacgguguacaaugcuuuucaagauacccugaccacaugaaacaacaugacuucuuuaaaagcgcaaugccagaaggauauguacaagaaaggacaaucuccuucaaagacgauggaacauauaagacaagagccgagguuaaauuugaaggugauaccuuagugaaccgaauagaauuaaaaggaaucgauuucaaagaagacgguaacauacuaggccauaaauuagaauauaacuucaacucacauaacguauauauaacagcagacaaacagaaaaacggaaucaaagcuaacuucaaaauaagacacaaugucgaagauggcucaguacaacuagcagaccacuaucaacaaaacacaccaauaggagacggaccaguacuucuaccagacaaccauuaccuauccacucaaucuaagcuaucaaaagacccaaaugagaaaagagaccauaugguucucuuggaguucguaacugccgccgguauaacccuaggaauggaugaauuauauaaauga

SEQ ID NO: 14433 - RNA, 4275 nt, Artificial Sequence
  Cas13d variant__Leptotrichia wadei __NLS-dLwCas13a-msfGFP
augaaacgaccggcugcaacgaagaaagccggacaagcgaaaaaaaaaaaaggaucaaugaaaguaacaaaaguagacggcaucagucauaaaaaauacauagaagaaggaaaacucguaaaaaguacauccgaagaaaacagaaccagcgaacgacuauccgaacuacucucaauucgacuagauauauauauaaaaaacccagauaaugcuagcgaggaggaaaacagaaucagaagagaaaacuuaaaaaaguuuuucuccaacaaaguacuucacuuaaaagauucuguuuuauaucucaaaaauagaaaagaaaaaaacgcaguacaagauaaaaauuacagugaagaagauauuucagaauacgaccuaaaaaacaagaauucauucagcguauuaaaaaagauucuacuaaacgaagacgucaauagugaagaacuagaaauauucaggaaagauguagaagcaaaguuaaacaaaauaaacagccuaaaauacucauuugaagagaacaaagcgaauuaccagaaaauaaacgaaaauaacguugaaaaaguaggcgguaaaucgaaacguaacauaauauacgacuauuacagggaaagugccaaaagaaacgacuacauaaacaauguacaagaagcuuucgacaaauuauauaaaaaggaagauauagaaaaacucuuuuucuuaauagagaacaguaaaaaacacgaaaaauacaaaauaagagaguauuaccauaaaauaauaggacguaaaaacgauaaagaaaacuuugcaaaaauaauauacgaagaaauucaaaauguuaacaacauaaaagagcuaauagaaaaaauaccagacaugagcgaauuaaagaaaucacaagucuucuacaaauacuaccuagauaaagaagaauuaaacgauaaaaacauaaaauaugccuucugucacuucguggaaaucgaaaugagccagcuacuaaaaaacuauguauauaaaagacuauccaacauuaguaacgacaaaaucaaaaggauuuuugaauaccaaaaccuaaagaaacuaaucgaaaauaagcuuuuaaauaaauuagacacauacguaagaaauuguggcaaauacaacuacuaccuucaaguuggagaaauagcgacauccgacuucauagcaagaaaucgccaaaaugaagcguucuuacgcaauauaauuggagucuccagcguagccuacuuuucacuaagaaacauacuagaaacagaaaaugaaaauggcauaacuggaagaaugcgcggaaaaacagucaaaaacaauaaaggagaagaaaaauacgucagcggagaagucgauaaaauuuacaacgaaaacaaacaaaaugaaguaaaagagaaucuaaaaauguuuuauucauacgauuuuaacauggauaauaaaaaugaaauagaagacuuuuucgcaaauauagacgaagcgauaaguagcaucgcacauggaaucguccacuuuaaccucgaauuagaaggaaaggauaucuucgccuuuaaaaacauagcgccauccgaaaucucaaaaaaaauguuccaaaaugaaauaaaugaaaaaaaacucaaauuaaagauauucaagcagcugaacuccgccaauguauucaacuacuaugaaaaagacgugauuauaaaauaucuaaaaaacacuaaauucaacuuuguuaauaaaaacauaccauucguaccaucauuuacaaaacuauauaacaagauagaagacuuacgaaacacacuaaaguuuuuuuggucuguacccaaagauaaagaagaaaaagacgcgcaaauuuacuuauuaaaaaacaucuauuauggagaauuuuuaaacaaauucguuaaaaacagcaaaguuuuuuucaaaauaacgaaugaaguaaucaaaaucaacaaacaaagaaaucaaaaaaccggacauuauaaauaccagaaauucgaaaacauagaaaaaaccguccccguagaauaccuagccaucauacagucacgagaaaugauaaacaaucaagauaaagaagaaaaaaacacguacaucgauuuuauacaacaaauauucuugaaaggauucauagacuaccuaaauaaaaacaauuuaaaauauauagagaguaauaauaacaacgacaacaacgauauauucagcaaaauaaaaauaaaaaaagacaacaaagaaaaauaugacaaaaucuugaaaaauuacgaaaagcacaauagaaacaaagaaauaccacacgagauaaaugaauucguuagagagauuaaacuugguaaaauauuaaaguauacagaaaaucuuaauauguucuaccuuauauugaaacuccuuaaccauaaagaacuaacuaaucuaaaaggaagccuagaaaaauaccagucagcaaacaaggaagaaacuuuuagcgacgaacucgaacuaaucaacuuauuaaaccuugacaacaaucgaguaacagaagacuucgaauuagaagccaaugagauaggaaaauuucuagacuucaacgaaaacaaaauuaaagauagaaaagaguuaaaaaaguuugacacgaacaaaauuuauuucgacggggaaaauauaauaaaacauagagcauucuacaacaucaaaaaauacgguauguuaaaccuauuagaaaaaauagcagacaaggcaaaauauaaaauaucccuaaaagaauuaaaagaauacucaaacaaaaagaaugagauugaaaaaaauuauacaaugcaacaaaacuuacaucggaaauacgcuagaccaaaaaaagaugagaaauuuaacgacgaagacuacaaagaauacgaaaaagcgauaggcaacauccaaaaguacacacaucuaaagaauaaaguagaauuuaacgagcuaaaccuacuccaaggccuacuacuaaaaauauuacaucgauugguaggauauacaaguauaugggaaagagaccucagauuuagguugaagggagaauuuccagaaaaucauuacauagaagaaauauucaacuucgauaacagcaaaaacguaaaauacaaaucuggacaaauagucgagaaauauauaaauuucuacaaagaacuuuauaaagacaauguagaaaaacgauccaucuacucagacaaaaaagugaaaaaauuaaaacaagaaaagaaagaccuguauauagcgaacuacauugcacauuuuaacuauauaccccacgcagagauaagccuacuggaaguguuagaaaaucuaagaaaacuacuaucauaugaccggaagcugaaaaaugcaauaaugaaaaguauaguagacauacugaaagaguauggcuuuguagcaacauucaaaauaggagccgauaagaagauagagauacaaacacuggagagugaaaaaaucguccaccugaaaaaccuaaaaaaaaaaaaauuaaugaccgacagaaacucagaagaacuaugugaauuaguaaaaguaauguuugaauauaaagcacucgaggguggaggaggauccgguggaggcgguucaggcggaggaggaaguguuuccaaaggagaggagcuauuuacaggcguaguaccuauucuaguagaacucgauggcgacgucaacggucacaaguucagcgucagaggcgaaggggaaggagacgcaacgaacggaaaacuuacauuaaaauuuaucuguacaacgggaaaacuaccgguuccauggccaacauuaguaacaacguuaacauacggaguacaaugcuuuucuagauacccugaucauaugaaacaacaugauuucuucaaaagcgcgaugccagagggguacguacaagaacgaacaauaagcuucaaagaugacggaacuuacaaaacacgagccgaaguuaaauuugaaggagauacacucgucaaccggauagaauuaaaagguaucgauuuuaaagaggacgguaacauucuaggacacaaguuagaauacaacuucaauagccacaauguauauauuacagcagacaaacaaaaaaacggaauaaaggccaauuuuaaaauaagacacaauguggaggacggcucaguacagcuagcagaccauuaccaacaaaacaccccuauaggagauggccccguccuauugccagacaaucauuauuuaagcacucaaagcaaacuuaguaaagaccccaacgaaaaaagggaucacaugguacuucucgaauuuguaacagcugcugguauaacauuaggaauggacgaguuauauaaauga

SEQ ID NO: 14434 - RNA, 2868 nt, Artificial Sequence
  Cas13d variant__Anaerobic digester metagenome 15706__AdmCas13d-HA
augaacaauaagcggaagaccaaagcaaaagcggcagggcucaaaagcguuuucuuugaccagaaacaagccguccucaccaccuucgccaaaggcaacaacagccaaauagaaaagaaggucgucaacagcgaggucaaagaccuccgccaacccccugcauucgaccuagaacucaaagagaaaaccuuuuacaucuccgguaaaaacaacaucaacacaucccgagaaaacccacuagccucagcgagccucccccuaucgaagcgccaacgcauccgggccgaacgaaucaaaagggcacgcgaggaaaaucgcccguaccauaacguuaaacgaguuggggaagaugaccuccgcgccaaagccgaccuggagaaacacuacuucggaaaagaauacuccgacaaccuaaagauccaaaucauuuauaacauacuagacauaaacaagaucaucagccccuacauaaacgacaucguauauaguaugaacaaccuugcccggaacgacgaauauaucgacggcaaaaucgacguuauaggcucccuauccuccacaaccgacuacucgucguucaugucucccaauaaggaccucgagaaggaaaagaaauucuccuuucaccgagaaaacuauaagaaauucguagaggcaagcaaacccuauaugcgcuacuauggcaaaguuuucauccgggacguuaagaaaagcaaacugucaaccggcaaaggagagaaaauagaagucauguaccgcagugaugaggaaauuuucacuaucuuucagauccucucguauguacgacaaucaauaaugcacaacgacauuggcaacaaaucauccauacuggcgauagaaaaauacccggcucguuuugucggcuuccuaagcgauuuacugaaaacaaaaacgaacgacgucaaccgcauguucaucgacaacaacucacaaacgaacuucuggguacuuuucagcauauucggacuccaagaccacacaagcggcgcagacaagaucugcaggaacuucuacgacuucguaaucaaagcagacuccaagaaccucggcuucagccuaaagaaaauacgggagcuaaugcucgaccuuccgaacgccaacaugcuacgggaccaccaauuugacaccguacgcucgaaauucuacacccuacuagacuucaucauauaccaacauuaccucgaggaaaaaucccgaaucgauaacauggucgaaaaacuccguaugacccuaaaagaggaagagaaggagguccucuacgcugccgaagccaaaaucgucuggaacgccaucggggccaaggucaucaacaaacuuguccccaugaugaauggagacgcccucaaggaaauaaaacgcaagaaccgggaccgaaaacugccccaaagcgugauagccaccguccaagucaacuccgaugcuaacgucuucagcgggcugaucuacuuccucacgcuguuccuggauggaaaggagaucaacgaaaugguuaguaaccucaucaccaaauucgaaaacauagauuccuugcuacacguggaccgcgaaauauacaaauccgacgaaaaggaucuugaccucgagauagaaaaacuagcacuauucuucaagggcguaguccgacccaacgcuaaaacugacaccggagccggagaaauauccaaauccuucuccauauuucaaucagccgaaaggauaauagaggaauuaaaauucaucaagaacgucacacgaauggacaaugaaauauuccccucugaaggaguauuccuggacgccgcaaacguacucggcguccgcggagaugacuucgacuucucgaacgaguucgucggagacgacuuacacucagacgcaaacaaaaagaucauuaacaaaauaaacggcacaaaagaagaccguaaccuacggaauuucaucaucaacaacgucguaaagucaaggcgauuccaauacauugccagacacaugaacacacacuacgucaaacagcucgcuaacaacgaaacgcucaaccgcuucguccucaauaaaaugggagacgcaaagaucauaaaccgguacuacgaaagcaucuccggaaacacaccaaacaucgagguacgcagccagaucgauuaccucgugaaacgccuccgcuccuucuccuucgaggaccucaacgacgugaagcaaaagguacgccccggcaccaacgaaucuauagagaaagaaaagaagaaagcacucguagggcuaugccucacgauccaauaccucguauacaaaaaccucgucaacauuaacgcccgauacaccacagcauuuuauugccuagaaagagacuccaaacuaaaaggauucggggucgauguuuggcgggacuuugaaucauacaccgcguuaacaaaccacuucauuaaagaaggguaccuacccguccgaaaagcagagauccuaagagccaaccucaaacaccucgacugcgaagacggauucaaguacuaccgaaaccaggucacccaccucaacgcaaucagaguagcauauaaauacauaaacgagauaaaaucgguccacuccuacuuugcccuguaccacuacauaaugcaacggcaucucuacgacucccuccaagccaaagccaaggacuccagcggguuugucaucgacgcacucaagaaaucauucgagcacaaaaucuacagcaaagaccuccuacacguacugcacaguccauucgguuacaacacugcccgauacaaaaaccuaagcaucgaagcacucuucgacaaaaacgaaucgcgaccagaagucaacccgcucagcaccaaugacuaccccuacgacgugccagacuacgcauga

SEQ ID NO: 14435 - RNA, 2868 nt, Artificial Sequence
  Cas13d variant__Anaerobic digester metagenome 15706__dAdmCas13d-HA
augaacaacaagcguaaaacaaaggcgaaagccgccggccuaaagagcgucuucuucgaccaaaagcaagccguacugaccaccuuugccaaaggaaacaacucccagaucgagaagaaagucguaaacuccgaaguaaaagaccuacgccaacccccagccuucgaucuugagcuaaaagagaaaacauucuacaucuccgggaagaacaacauuaacacaucccgggaaaacccacuagccuccgcgucccucccccuaucuaaacgccaacggauccgagccgaacguaucaaaagagcgcgggaagaaaaccggcccuaccacaacgucaaaagaguaggagaggacgaccuaagagccaaagcggaccucgagaagcacuacuucggcaaggaauacucagacaaccucaaaauacagaucaucuauaacauacuagauaucaacaaaauaauaucccccuacaucaaugacauaguauacuccaugaauaaccuggcccggaacgacgaguacaucgauggcaaaaucgauguaauaggcucguuaagcucuaccaccgacuacagcagcuucaugucgcccaacaaagaccucgaaaaagagaagaaauucagcuuccaucgcgaaaacuacaagaaauucguagaagccucuaaacccuacaugcgguacuacgggaaagucuucauacgagacgugaaaaaguccaaacuuuccaccggaaaaggggaaaagaucgaaguaauguaccgcuccgacgaagagaucuucaccauauuccaaauccucuccuacguagcacaauccaucauggcuaacgacaucggcaacaaguccagcauccuugccauagagaaauacccagcccgauucguggguuuccucuccgaccuacucaagacuaaaacaaacgauguuaaccgaauguucauagacaacaacagccaaaccaacuucuggguccuuuucuccaucuuuggccuccaggaccacacguccggagccgacaaaaucugccgaaacuucuacgacuucguaaucaaagccgauucgaaaaaccuaggguucucccuuaagaaaauccgcgaacucaugcuggaccuacccaacgccaacaugcuacgagaccaccaauucgauaccguacgaagcaaauucuacacacuacucgacuucaucaucuaccaacacuaccuggaagaaaagagccggauugacaacaugguggagaagcugagaaugacacucaaagaagaagaaaaagaggugcucuacgccgcagaagcgaaaaucguuuggaacgccaucggggccaagguuaucaacaagcuagugccaaugaugaacggcgacgcccucaaagaaauaaagcgcaaaaaccgagaccguaaacucccccaguccguaaucgcuacagugcaaguaaacagcgacgccaauguauucucgggacugaucuacuuccucacucucuuccucgacgguaaagaaauaaacgaaauggucucuaaccucaucacaaaguucgaaaacauagacagccuacugcaugucgaccgcgaaauauacaaauccgacgaaaaagaccuugaucuggaaaucgaaaaacucgcccuauucuucaaaggcgucguacgccccaacgccaaaacggacacaggagcgggcgagaucagcaaaucauucuccauuuuccaauccgccgaacguauaaucgaggaauuaaaguucaucaaaaacguaacaagaauggacaacgaaauauuccccuccgaaggggucuuccucgacgcagcaaacgugcuaggcguccgcggagacgacuucgacuucucaaacgaauuugucggagacgaccuacacucugacgccaacaagaaaaucaucaacaaaauuaacggcaccaaagaggacagaaaccugcgaaacuucaucaucaauaacguugucaaaucucggcgcuuccaauauauagcacgccacaugaacacccacuacgucaaacagcuagccaacaacgagacacucaaucgauucguccuuaacaaaaugggcgacgcgaagaucaucaacagauacuacgaaucaauauccgguaacaccccuaauaucgaaguccggucacagauagacuaccucguuaagcgccuccgaucauucagcuucgaagaccucaacgacguaaagcaaaaggugcguccagguaccaacgaauccaucgagaaagagaaaaagaaagcacucguuggacuuugccuaaccauacaguaccucguuuacaaaaaccuugucaacauaaacgcacgcuacacaacagcuuucuacugccucgaacgcgacucaaaacucaagggcuucggcgucgacgucuggcgagacuuugaaagcuacacagcucucaccaaccacuucauuaaagaagguuaccuaccuguucgaaaagccgaaauccuacgugccaaccuaaagcacuuggacugugaagacggguucaaauacuacgcaaaucaggucacagcccuuaacgccauccgaguggccuauaaguacauaaacgagauaaaaagcguccacucauauuucgcccucuaccacuacauaaugcaacgacaccuauacgacagccuccaagcaaaagccaaagacucaucaggauucgucauagacgcgcucaagaaaucauucgaacacaaaaucuacaguaaagaccuacuucaugugcuacauagcccuuucggauacaauacugcacgcuacaaaaaucucagcaucgaagccuuguucgacaagaaugaaucccggccagaagugaacccccuaagcacaaacgacuacccauacgaugucccggacuacgccuga

SEQ ID NO: 14436 - RNA, 2940 nt, Artificial Sequence
  Cas13d variant__Anaerobic digester metagenome 15706__NLS-AdmCas13d-NLS-HA
augagcccgaaaaagaaacgcaaagucgaggcguccaacaacaaacgcaaaacgaaagccaaagcagcaggacuaaaaagcguguuuuucgaccaaaaacaagcagugcuaaccacauucgcaaagggaaacaacucgcaaaucgaaaagaaaguagucaacagcgaggucaaggaucuucgccaaccaccagccuucgaccuggagcugaaagagaaaaccuucuacaucuccggcaaaaacaauaucaacaccucaagagaaaacccacuagccucagccucacucccgcucaguaaacgccagagaauccgcgccgaaagaauaaaacgggccagagaagaaaaucgaccauaccacaacgucaagcgagucggcgaagacgaccugcgcgccaaggccgaccuagaaaagcacuacuucggaaaagaauacucggacaaucugaaaauccagaucaucuacaauauucuagacaucaacaagaucaucagucccuacauaaaugauaucgucuacagcaugaacaaccuugcacgaaacgacgaauacaucgacggaaaaaucgacgugauaggcucacuaagcagcaccaccgacuacagcucauucaugucacccaacaaagaucucgaaaaagaaaagaaauucuccuuccacagggagaacuacaagaaauucgucgaagcaagcaaacccuacaugcgauacuacgggaaggucuucauccgcgaugucaagaaauccaaacugucaacaggcaagggcgagaaaauagaaguaauguauagauccgacgaagagaucuuuacaaucuuucagauacuauccuauguaagacaauccauaaugcacaacgacaucggcaacaaguccagcauccuagcgaucgaaaaauaccccgcccgguucgucggcuuccucuccgaccuacuaaagaccaagacaaacgacguaaauaggauguucauugauaauaacagccagacuaacuuuuggguccucuucuccauuuucggccuacaggaccauacauccggcgcagauaaaaucugcagaaacuucuacgacuucguaaucaaagcagacuccaagaaccugggauucagccucaaaaagauacgagagcugaugcuagacuugcccaacgccaacauguuacgugaucaucaauucgacacagucagauccaaauucuacacccuacucgacuucauaaucuaccaacacuaccucgaagaaaagucccgcauagacaacauggucgaaaaacuuagaaugacucucaaggaagaagaaaaggaaguacucuacgccgcugaagcaaaaaucgucuggaacgcgaucggcgcaaaaguaauaaacaaacucguacccaugaugaacggagacgcacuaaaagaaaucaaacgcaaaaaucgagaccgcaagcuaccccaauccguuauugccaccgugcaaguaaacuccgacgccaacgucuucuccggacuaaucuacuuccuuacacuguuccuggacggcaaagagauaaacgaaauggugagcaaccucaucaccaaauucgaaaacaucgacucgcuccuccauguagaccgcgagaucuacaaguccgaugagaaagaccuagaccucgagaucgagaaacuagcccucuucuucaaagguguaguccgccccaaugccaagaccgacacaggcgcgggcgaaauuucaaaguccuucucgaucuuccaaagcgcugaacgcaucaucgaagaacucaaauuuaucaaaaacguuacccggauggacaacgagauauuucccuccgaaggcguauuccucgacgccgcgaacguacucggagugaggggugacgacuucgacuuuagcaacgaguucgucggugacgaccuccacuccgaugccaacaagaaaauaauuaacaaaaucaacggaacuaaagaagauaggaaccuacgaaauuucaucauaaacaacguaguaaagagccgccgcuuccaauacaucgcucggcauaugaacacccacuacgucaaacagcuggccaacaacgaaacacugaaccgcuuuguacuaaacaaaaugggugacgcuaagaucaucaaccgcuauuacgagucgauaaguggcaauacgccaaacaucgagguacgaucucagaucgacuaccuggucaaaaggcuacggagcuucagcuucgaagaccuaaacgacgucaagcagaagguacgaccgggaaccaacgaaucaauagaaaaggaaaagaagaaagcccucgucggacucugccucaccauccaauaccuaguguacaagaaucuggucaacaucaacgcccgauacaccacagccuucuacugccucgaacgagacucgaagcuaaaaggguucggagucgacguauggcgagacuucgaguccuauaccgcgcucacaaaucacuucaucaaagagggcuaccuucccguucgcaaggcagagauucuucgcgcaaaccuaaagcaccucgacugcgaggauggcuuuaaauacuaccgaaaucaggugacccaccuuaacgccauccguguagccuacaaguacauaaaugaaauaaaauccguccacuccuacuucgcacuuuaccauuacaucaugcaacgacaccucuacgauucacuccaagcuaaggccaaagacuccucaggcuuugucauugacgcacucaaaaagagcuucgaacacaaaauauacagcaaagaccuccuccaugugcugcacucccccuuuggcuacaacaccgcccgauacaaaaaucugagcauagaagcccuauucgacaaaaacgaaagccgccccgaaguaaacccccucuccacgaacgacggcucggggcccaaaaagaaacggaaaguggcggccgcauaccccuacgauguccccgauuacgccuga

SEQ ID NO: 14437 - RNA, 2940 nt, Artificial Sequence
  Cas13d variant__Anaerobic digester metagenome 15706__NLS-dAdmCas13d-NLS-HA
augucacccaaaaagaaacgcaaagucgaggcuagcaacaacaaacgaaaaaccaaagccaaagcggcgggccucaaaagcgucuucuucgaccaaaaacaggcaguccucacaacguucgcaaaaggcaacaacucgcaaauagagaagaaagucgucaacagcgaagugaaagaccuacgccagcccccagcauucgaccuagaacuuaaagagaaaaccuucuacaucagcggcaaaaacaacaucaacacuucacgggagaacccacuagcaucugcuagccucccccugucaaaacgccagcgaauccgagcagagcgaaucaaacgagcccgagaggaaaacagacccuaccauaacguuaaacguguuggggaagaugaccuccgcgccaaggcagaccuugaaaagcauuacuucggcaaagaauacucagacaaccugaagauacaaaucauauacaauauccucgacaucaacaaaaucaucagccccuacaucaacgauaucgucuauuccaugaacaaucucgccagaaacgaugaguacaucgacggcaaaauagacgucauaggaucccuaucaagcacuaccgacuacucgagcuucaugucccccaacaaagaccuagaaaaagagaaaaaguucagcuuccaccgcgaaaacuacaagaaauucguggaggccuccaaaccuuacaugagauacuacggcaaagucuucauacgcgacgucaagaaaaguaaauuaaguaccggaaaaggcgagaaaauagaagugauguaccgauccgacgaagaaaucuucaccauuuuccagauccuaagcuacguagcucaaucaauaauggccaacgacauuggaaacaaaucgucaauacuggcgauagaaaaauaccccgcccgguucguggguuuccuaagcgaccugcucaaaaccaaaaccaacgacgucaaucgcauguucauagacaacaacagccagacgaacuucuggguccuauucucuauauucgggcuacaggaccacaccagcggagcggacaaaaucugccgcaacuucuacgacuucgucauaaaagccgacuccaaaaaccuaggcuucagccuaaagaaaauacgagaacucaugcuagaccuaccgaacgccaacaugcugcgagaccaccaguucgacacuguaaggagcaaauucuacaccuugcucgacuucaucauauaccagcacuaccuggaagagaaaucucgcauagacaacaugguagaaaaacuacgaaugacccucaaagaagaagaaaaggaagugcucuacgcggcagaagcgaagauugucuggaacgcuauaggagccaagguaaucaacaaacucguacccaugaugaacggugacgcgcucaaagaaaucaagaggaagaaccgcgaccgcaaacuaccccaaagcguaaucgcaacaguacaaguaaacagcgacgcuaacgucuucucaggacucauauauuucuugacccucuuccuugacgggaaggaaaucaacgagauggucagcaaccucauaacaaaguucgaaaacaucgauucccuccuccacguugacagagaaauauauaaauccgacgaaaaagaccucgaccucgagauagaaaaacucgcccucuuuuucaagggggucguccgcccaaacgcaaagacugacacaggugccggcgagauuagcaaauccuucuccaucuuccagagcgccgaacgcauuaucgaggaacucaaguuuaucaagaacgugacaagaauggacaacgagaucuuucccuccgaaggugucuuccuagacgcagcgaacguucuuggcgucagaggcgacgacuucgacuuuagcaacgaguucguaggcgacgaccuacacagcgacgcaaacaagaaaaucauaaacaaaauaaacggaaccaaagaagaccgcaaccuccgaaacuuuauaaucaacaacguugucaaaucgcgacgcuuccaguacaucgcgcgacauaugaacacgcacuacgucaaacagcucgccaauaacgagacgcucaaccgcuucguccucaacaaaaugggcgacgcgaaaaucaucaaccgcuacuacgaauccauaagcggcaacacgccaaacauugaagucagaagccaaaucgacuaccucgugaaacgccuucgcucauucagcuucgaagaccuaaacgauguaaagcagaagguacggccaggaacaaacgaauccaucgaaaaagagaaaaagaaagcucuaguaggguugugccuaaccauccaauaucucguauauaaaaaccugguaaacaucaaugcaagguauacgacagcauucuacugccucgaaagggacuccaaacucaaaggauucggcguagacgucuggcgggacuuugaguccuacacagcccuaacgaaccauuucaucaaagagggauaccuacccguccgaaaagccgaaauacuacgcgcgaaccuaaagcauuuagacugcgaagacggauucaaguacuacgcaaaccaagucacagcucucaacgcaauacgaguggccuacaaauacauaaacgagaucaaaucaguccacucauacuucgcacucuaucacuacauaaugcagcgacaccuauacgacucgcugcaagccaaggcaaaggacucauccggguucguuaucgacgcccucaaaaagagcuucgaacacaaaaucuacagcaaagaccuacuacauguucuccacucaccauucggcuacaacacugccagauauaaaaaucucucgaucgaagcccucuucgacaaaaacgaaucacgaccagaagucaacccccugucaaccaacgacggcuccggacccaagaagaagagaaagguagccgcagccuacccguaugacguucccgacuacgccuga

SEQ ID NO: 14438 - RNA, 2892 nt, Artificial Sequence
  Cas13d variant__Eubacterium siraeum DSM15702__EsCas13d-HA
augggaaagaaaauacacgcgcgcgaccuccgcgagcaacgcaaaaccgaccgaaccgaaaaauucgccgaccagaacaagaaacgagaagccgagcgcgcuguucccaagaaagacgccgccgucucagucaaaagcgucuccagcguaagcagcaagaaagacaacgucaccaaaucaauggccaaagcagcaggagucaaaucggucuucgcagugggcaacacagucuacaugaccuccuucgggcgaggaaacgaugccguacucgaacagaaaaucguagacaccucccacgagccccucaacaucgacgacccggccuaucaacuaaacgucgucacuaugaacggauacagcgucacaggucacaggggcgaaacugucuccgcaguuacggacaacccccuacggcgauuuaacggccgcaagaaagaugaaccagaacaaagcgugcccaccgacaugcucugccuaaaacccacccucgaaaagaaauucuucggcaaagaguuugacgacaacauacacauacaacugauauacaacauccuagacaucgagaaaauacucgccgucuacucaacaaacgcaaucuacgcacuaaacaacaugagcgcagacgaaaacaucgaaaacagugacuucuucaugaaaaggacaacagacgaaacguucgacgacuucgagaaaaagaaagaaagcaccaacagccgcgaaaaagccgacuucgaugccuucgaaaaauucaucgggaauuaccgacuagccuacuucgcggacgcauucuacgucaacaagaaaaacccaaaaggaaaagccaagaacguacuacgcgaagacaaagaacuauacucgguucuaacacuuauaggaaaacuccgccacuggugcguccacuccgaagaaggacgcgcggaguucuggcuguauaaacuagacgaacucaaggacgacuucaagaauguacucgacgucguauacaaccgaccaguugaagaaaucaauaaucgcuucauugaaaacaacaaagucaacauccaaauccuaggcagcguauacaaaaacacagacauugcggaacuuguccgcagcuacuacgaguuucucaucaccaagaaauacaaaaacaugggcuucuccaucaagaaacuccgagaaagcauguuggaaggcaaaggcuacgcagacaaagaauacgacuccgugaggaacaagcucuaccaaaugaccgacuucauccuguacaccggauacauaaacgaagacagcgacagggcggacgaccuggugaacacucucagaucuagccuaaaggaagacgacaagaccaccgucuauuguaaagaagcggacuaccuauggaagaaauaccgagaaagcauacgugaggucgccgacgcccucgacggcgacaacauaaagaaacucuccaaauccaacauagaaauccaagaggacaaacuccgcaaaugcuuuaucucguaugccgacucaguaagcgaguucacaaaacucaucuaccuucuaacccgcuucuugucaggcaaagaaauaaacgaucucguaaccacccucaucaacaaguucgacaacauacgcucauuccucgaaauaauggacgaacucggccucgaccgcaccuucacagcugaauacagcuucuucgaaggcagcacgaaauaccuagcagagcugguagaacucaauagcuucguaaaaucguguagcuucgacaucaaugccaagcguacaauguaccgagacgcacucgacaucuugggcauagaaagcgacaagaccgaagaggacaucgagaaaaugauugacaacauacuccagaucgacgccaacggcgacaagaaacucaagaaaaacaacggucuacgaaacuucauagcauccaacgucauagacuccaacagauucaaauacuugguaagauacggaaauccgaagaaaauucgagaaaccgcuaaaugcaaaccggccguccgcuucguacuaaacgaaauuccggacgcacaaaucgaacgcuacuacgaagcaugcugucccaaaaacacggcccugugcuccgccaacaaacgccgggaaaaacucgccgacaugauugcagaaaucaaauucgaaaacuuuuccgacgcgggaaacuaccaaaaagccaacguuacaucaagaacuuccgaagccgaaauuaaacguaaaaaccaagccaucaucagacuauaccucaccguaauguacaucauguuaaagaaccugguaaacgucaaugcaagauacguaaucgccuuccacugcgucgagagggauacuaaacuauacgccgaaagcgggcucgaaguggggaacauagagaaaaacaaaaccaaccuaacgauggccgucaugggagucaaacuugaaaacggcauaaucaagaccgaguucgacaaaaguuucgcagaaaacgcagccaaccgauaccuaaggaacgcccgcugguauaaacuaauucucgacaaccucaagaaauccgaaagagccgucguaaacgaguuccggaauacaguaugccaccucaaugcaauacgaaacaucaacaucaacaucaaagaaaucaaagaaguggaaaacuacuucgcccuguaccacuaucuaauacaaaaacaccucgaaaaccgcuucgccgacaagaaagucgaacgcgacacgggcgacuucauaagcaaacuagaggaacacaaaaccuacugcaaagacuucguaaaagcguauuguacucccuucggcuauaaccugguccguuacaaaaaccucaccaucgacggccucuucgacaaaaauuacccaggcaaagacgacagcgacgaacaaaaauaccccuacgacgucccggacuacgccuga

SEQ ID NO: 14439 - RNA, 2892 nt, Artificial Sequence
  Cas13d variant__Eubacterium siraeum DSM15702__dEsCas13d-HA
augggcaagaaaauacacgccagagacuugcgcgaacaacgaaaaacggacagaacggaaaaauuugccgaccaaaauaagaaaagagaggcggaacgagccguaccgaagaaagacgccgcaguauccguuaaauccguauccucagucucgucgaagaaagacaacguuaccaaauccauggcaaaagcugccggcgucaaaagcgucuucgccguuggcaacacaguguacaugaccucauucggcaggggcaacgacgcugugcuggagcagaaaaucgucgacaccagccacgagccucuuaacaucgacgauccggccuaccaacuaaacgucguaaccaugaacggauacucagugacaggccaucgaggagaaacagucuccgcaguaacagacaauccccuccguagauucaacggccgcaagaaagaugaaccggaacaaucagucccaacggacaugcuaugucugaaaccaacguuagagaagaaauucuucggcaaagaguucgaugacaacauacauauccaacucauauacaacauacucgacaucgagaaaauauuagccguguacagcacaaacgcgaucuacgcacuuaacaacaugucagccgacgaaaacauagaaaauagcgacuucuucaugaaacggacgacagaugaaaccuucgacgacuucgagaaaaagaaggaaucaaccaauucacgcgaaaaagccgacuucgacgccuucgagaaauucauagggaacuaccgcuuagcauacuucgcagacgcguucuacgucaacaagaaaaacccaaaagguaaagccaaaaacguacucagggaggacaaggaacuauauuccguacucacacuaauaggcaagcucgcccacuggugcgucgccuccgaagaaggccgugccgaguuuuggcucuacaaacucgacgaacuaaaggacgacuucaaaaacguucuggacgucgucuacaaccgcccagucgaggaaaucaacaaccgauucauagagaacaacaaagucaacauacagauccuaggaagcgucuacaaaaacacugacaucgcggagcugguccgcuccuacuacgaguuccugaucaccaaaaaguacaaaaacaugggguucagcauuaagaaacuccgcgaaagcaugcucgaaggcaaaggcuacgcagacaaggaauacgacucaguccgcaacaagcucuaccaaaugacggacuucauccuauacaccggcuacauaaaugaagacuccgaccgggcggacgaccucgucaacacgcucagaaguucccucaaagaagacgacaaaacaacggucuauugcaaggaagcggacuaccucuggaagaaauaccgcgaaagcauacgagaagucgccgacgcacucgacggcgacaacauuaagaaacuauccaaauccaacaucgaaauacaggaagacaaacugcgcaaaugcuucauaucauacgcagacagcgucagcgaauuuacgaaacucaucuaucucuuaacucgguuccuaucaggcaaagaaaucaacgaccuagucacuacacucaucaacaaauucgacaacauucgcagcuuccuagaaaucauggacgagcucggucucgaccgaacguucaccgccgaauacagcuucuucgaaggcagcaccaaguaccuagcagagcucgucgaacuaaacuccuucguaaaguccugcagcuucgacaucaacgcgaagcgaacaauguaccgagacgcccucgacauccucggcaucgagagcgacaaaaccgaggaagacaucgagaaaaugaucgacaacauacuccagaucgacgccaacggcgacaagaaacucaagaaaaacaauggccugcgaaauuucauugcgagcaacguaauagacaguaaccgguucaaauaccuaguucgcuauggcaaccccaagaaaauacgagaaacggccaaaugcaaaccagccguccgauucguauuaaacgagaucccagaugcacaaauugaacgcuacuacgaagccugcugcccuaaaaacacagcccuuugcagcgccaacaaaagacgggagaaacuagcagacaugauagccgaaaucaaguucgaaaacuucagcgacgccggcaacuaccaaaaggcaaacgugaccagccgaacaucagaagcagaaaucaaacggaaaaaccaagcgaucauccgacucuaccucaccgucauguacauaaugcugaaaaaccucgugaacguaaaugccagauacguaaucgccuuccacugcgucgaaagagacacaaaguuguaugcggaauccggccuugaaguagggaacauagaaaagaauaagaccaaccucaccauggccguaaugggagucaaguuagaaaacgguaucaucaaaaccgaguucgacaagagcuucgccgaaaacgccgccaacagauacuugcgcaacgcaagaugguacaaacuaauucucgacaaccuaaagaaaagugaaagggcaguagucaacgaguucgcgaacacggucugcgcccugaacgcgaucaggaacauuaacauaaacauaaaagaaaucaaagaaguggagaauuacuucgcacucuaccauuaccugauucaaaaacauuuagaaaacagauucgcagacaagaagguagaaagagacacaggagacuucauauccaaacuugaagaacacaaaaccuacugcaaggacuucgucaaagcguacugcacgccauucggauacaaccuaguccgcuacaagaaccucacgauagacggccucuucgacaaaaacuauccaggaaaagacgauucggacgagcaaaaauacccauacgacgucccggauuaugccuga

SEQ ID NO: 14440 - RNA, 2964 nt, Artificial Sequence
  Cas13d variant__Eubacterium siraeum DSM15702__NLS-EsCas13d-NLS-HA
augucgccuaaaaagaaaagaaaaguagaagccaguggcaagaaaauacacgcacgagaccuuagggagcaaaggaaaaccgacaggacagaaaaguucgcagaccaaaacaagaaacgcgaagccgaaagggcggugcccaagaaagacgcagcagugucagucaaaagcgucagcagcgucucaagcaaaaaggacaacgugaccaaaagcauggccaaggcugcgggggucaagucagucuucgccguaggaaacacagucuacaugaccuccuucggccguggcaacgacgccguccucgaacagaaaaucgucgacacaagccacgagccccucaauaucgacgacccggcauaccaauuaaacguagucacgaugaacggguacuccgucaccggacaucguggcgaaaccguguccgccguaacagacaauccucuacgucgauucaacggucggaagaaagaugaaccagaacaaucaguccccaccgacaugcucugucuaaaacccacccucgaaaagaaauucuucggaaaagaguucgacgacaacauccauauacaacucaucuauaacauccucgacaucgagaaaauccucgccguauacagcacaaacgcgaucuacgcacuuaacaacaugucggcagacgaaaacauagaaaacuccgacuucuucaugaaacgaaccaccgacgaaaccuucgacgauuucgagaaaaagaaagaaucaaccaacagcagggaaaaagccgauuucgacgccuucgaaaaauucauagggaacuacaggcuagccuacuuugccgacgcauucuacguaaacaagaaaaacccaaaaggcaaagcaaagaacgugcuccgagaagacaaagaacucuacucagugcucacccucaucggcaagcuacggcacuggugcguacacucggaagagggucgcgcagaguucuggcucuacaaacucgaugaacuaaaagacgacuucaaaaacguccucgauguagucuacaaucgccccgucgaagaaaucaacaacagauucaucgaaaacaacaaagugaacauucaaauccuaggaagcguuuacaaaaacaccgacaucgcugagcuaguacgaagcuacuaugaguuccugaucaccaagaaauauaaaaacaugggcuucagcauaaagaaacugcgagaaagcaugcucgaagguaaaggauacgccgacaaagaauacgacuccgucagaaacaaacuguaccagaugacagacuucauacuauacaccggcuacauaaacgaagacuccgaucgcgcagacgaccuaguaaacacccuccgaagcucgcucaaggaagacgacaaaacaacaguauacugcaaagaagcggacuaccuauggaagaaauacagggagaguauccgggaaguagcggacgcgcuagacggcgacaauaucaagaaacuaucaaaaagcaacauugaaauccaggaagacaagcuccgcaaaugcuucaucagcuacgcugacagcgucagcgaguucacaaagcucaucuacuuacugacacgauuucuaucaggaaaagagauaaacgaccucguaaccacacucauaaacaaguucgacaacauaagauccuuccuagaaauaauggaugaacuaggccuggaccggaccuucaccgccgaguacagcuucuucgagggaucaacaaaguaccucgccgaacuggucgaacuaaacucguucgucaaguccugcagcuucgacauaaacgcgaagcgaacgauguaccgcgacgcacuagauauacucggcaucgaaucagacaaaaccgaagaagacaucgagaaaaugaucgacaacauacugcagaucgacgccaacggcgacaagaagcuaaagaaaaacaacggccuccgcaauuuuaucgcguccaacguaauagauagcaacagauuuaaauaccuggugcgcuacggaaaccccaagaaaauccgcgaaaccgcaaaaugcaaaccagcaguccgcuuuguccuaaacgaaaucccagacgcacaaaucgaacgcuacuacgaagccugcugccccaagaacacagcucucugcucggccaacaaaaggcgagaaaaacucgcagacaugaucgcugagaucaaauucgaaaacuucagcgacgcaggcaacuaucaaaaagccaacgucaccucacgaaccucagaagccgaaaucaaacguaaaaaccaggccaucauccgacucuacuugacagucauguacauaaugcuuaaaaacuuagucaacgucaaugcccgcuacguuaucgcauuccauugcguagaacgcgacacaaaacuguaugccgaaaguggacucgaagucggcaacauagagaaaaacaaaacaaaccuuaccauggccguaaugggagucaaacucgaaaacgggauaaucaagacggaguucgacaaauccuuugccgaaaacgccgccaaccgcuaccuccgaaacgcacggugguacaaguuaauacucgacaacuuaaagaaaagcgaaagagccgucgucaacgaguuccguaacaccguaugucaccuaaacgccaucagaaacauaaacaucaacaucaaagaaaucaaagaaguggaaaacuacuucgcccucuaccacuaccuaauacaaaaacaccucgaaaaccgauucgcggauaagaaagucgagcgcgauacaggcgacuucauaagcaaacucgaagaacacaaaacguacugcaaggacuucgucaaggcauacugcaccccguucggauacaaccuaguucgcuacaaaaaccugacaauagacggauuguuugacaaaaacuaccccggcaaagacgacagcgacgaacaaaaagggagcggacccaaaaagaaacgcaaaguggccgcggcguaccccuacgacguccccgauuacgcuuga

SEQ ID NO: 14441 - RNA, 2964 nt, Artificial Sequence
  Cas13d variant__Eubacterium siraeum DSM15702__NLS-dEsCas13d-NLS-HA
augucccccaaaaagaaacgcaaagucgaggccuccgguaagaaaauacacgcucgagaucuccgggaacagcggaaaacggaccgcacagaaaaauuugccgaccaaaauaagaaacgcgaagccgaacgcgccgugcccaagaaagacgccgcagucagcgucaaaagugugucauccgucucguccaagaaagauaacguaaccaaaagcauggcuaaagcagccggcgucaaaagcgucuucgcaguaggaaacaccguuuacaugaccagcuucggccgggggaaugacgccguacuggagcagaaaaucguagacaccagucacgagccacucaacauagacgauccagccuaccaacugaacgugguaaccaugaauggcuacucagucacagggcaccgaggggagacggucucagccguaacagacaacccccuccgcagauucaacggccgcaaaaaggacgaacccgaacaaagcguaccuacugacaugcuaugccuaaaaccuacacucgaaaagaaauucuucggcaaagaguucgacgacaacauccauauacaauuaauauacaacauccuggauaucgagaaaauccuagcaguauacagcacgaacgccauauacgcucuaaacaacaugagcgcagacgaaaacauagaaaacuccgauuucuucaugaaacgaaccacggacgaaacguucgacgacuucgaaaagaaaaaggaauccacgaacucacgcgaaaaagcagacuucgacgcguuugaaaaauucauagggaacuaccgccuagccuauuucgcggacgcguucuacguaaacaagaagaaccccaaaggcaaggccaaaaacguccuaagagaagacaaagagcuauacucgguucuaacgcucauagggaaacuagcgcacuggugcgucgcuagcgaggaagguagagccgaguucuggcucuacaagcuggacgagcucaaagacgacuucaaaaacgugcuggacgucgucuauaaccgaccagucgaagagaucaacaacagauucaucgaaaacaacaaaguaaacauccaaauccucggcuccguguacaaaaacacggauaucgcagaacucguccgaagcuacuacgaguuccucaucaccaagaaauacaaaaacaugggcuucucgauuaagaaacugcgcgaauccaugcucgaaggcaaaggguacgcggauaaagaguaugauagcguaagaaacaaauuauaccaaaugaccgacuucauccucuauacaggauacaucaacgaggacucagaccgcgccgacgaccugguaaacacgcuucgaucgucacucaaggaggacgacaaaaccaccgucuacugcaaagaggcagauuaccuguggaagaaauaucgggagagcauacgagaaguagcagacgcccuagacggcgacaauaucaagaaacugucgaaaucaaacaucgagauacaagaagauaaacuccgcaaaugcuucauaaguuacgcggacucggucagugaguucacgaaacucaucuaccugcuaacgagauuucucucgggaaaagaaauaaacgaucuuguaaccacacucaucaacaaauuugacaacauccggaguuuccucgaaaucauggaugaacucggccuugacagaaccuucacagcagaguacagcuucuucgaaggaucgaccaaauaccucgccgagcuaguagaacuaaauaguuucgugaaaagcugcagcuucgacauaaacgccaagcgcacgauguaccgugacgcccuggauauacuugggauugaaagcgacaaaaccgaagaggacaucgaaaagaugauagacaacauacugcaaaucgacgcgaacggcgacaagaaacugaagaaaaacaacggccuacgcaacuucauagccagcaacgugauagacuccaaucgauucaaauaccucgugagauacggcaacccaaagaaaauccgagaaaccgccaaaugcaaaccggccguccguuucguacucaacgagauucccgacgcgcaaaucgaaagauacuacgaagcaugcugucccaaaaacaccgcucuaugcucagccaacaaacguagagagaaacuagccgacaugaucgcagagauaaaguucgaaaacuucuccgaugccggaaacuaccagaaagccaacgucaccagccgaacgagcgaagcggaaauuaaacgcaaaaaccaagcaauaauacgccucuaccugaccgugauguacaucaugcucaaaaaccuagugaacgucaacgcacgauacguaauugcguuccacugcguagaacgcgacacgaaacucuaugcagaaaguggacucgaagucgguaacaucgaaaagaauaagacgaaucuaaccauggccgugaugggcgugaaacuggagaacggcaucauaaaaacagaguucgacaagagcuucgccgaaaacgccgcgaaccgauaccuacgaaacgcgcgcugguacaaacuuauacuagacaaccucaagaaaagcgaacgagccguagucaacgaguucgcaaacaccgucugcgcacuaaacgcgauccguaacaucaacauaaauauaaaagaaaucaaagaaguagagaauuacuucgccuuguaccacuaccucauccaaaagcaccuagaaaacagauucgccgacaaaaagguagagagggacaccggagacuucaucuccaagcucgaagaacauaagaccuacugcaaagacuucgugaaggcauacugcaccccguucggauacaaccucgucagauacaagaaccucacaaucgacggacucuucgacaaaaacuacccaggcaaagacgacucugacgaacaaaaaggaagcggacccaaaaagaaacgcaaaguugcggcagcauacccuuacgacguccccgacuacgcauga

SEQ ID NO: 14442 - RNA, 3402 nt, Artificial Sequence
  Cas13d variant__Eubacterium siraeum DSM15702__PspCas13b-NES(HIV)-3xHA
augaacaucccagcccuagucgaaaaccagaagaaauacuucggcaccuacucagucauggccaugcugaacgcucagacaguauuggaccacauacaaaaaguagcagacaucgaaggugagcaaaacgagaacaacgaaaaucuuugguuccacccagugaugagccaccuauacaacgccaaaaacggcuacgacaaacagccagagaaaacgauguucaucauugaacgacugcaguccuacuuucccuuccucaaaaucauggcagaaaaccaacgcgaauacuccaacggaaaauauaaacaaaaccgcguagaaguaaacucaaacgacauauucgaaguacugaagagggcauuuggcguguugaaaauguaccgagaccucacaaaccauuacaaaaccuacgaagagaaacugaacgacgggugcgaguuccucacaagcaccgaacagccgcuaagugggaugaucaacaacuacuacacugucgcccuccgcaauaugaacgaaagauauggcuacaaaaccgaagaccuggccuucauacaagacaaacgcuucaaguuuguaaaagacgccuacgggaaaaagaaaagccaggugaacaccggcuuuuuccucagucuacaagacuacaacggcgacacccaaaagaaacugcacuuaagcggcguaggaauagcacugcucauaugccuuuuccucgacaaacaauacauaaacauauuccucagcagacucccaauauucucaagcuacaacgcccaaagcgaagaaagacgaauaauuauacgcuccuucggaauaaacuccaucaaacucccaaaagacagaauccacagcgaaaaaucaaacaaaucggucgccauggacaugcucaacgaagugaagcgaugccccgacgaauuauucaccacccuaagcgcagaaaagcaaucgcgauuccgcaucaucagcgaugaccacaacgaaguacucaugaagcguagcagcgacagguucgucccccuacuacuccaguacauagacuauggaaagcuauucgaccacauaagauuccauguaaacauggggaaacuccguuaccugcucaaagcagacaagaccuguaucgaugggcaaacucgcguacgcgugaucgaacaaccacucaacggcuucgggaggcuagaagaagcggagacgaugcgaaaacaagaaaauggcaccuucgguaacucaggaauaaggauccgcgacuucgaaaacaugaaacgggacgaugccaacccagccaacuaccccuacaucgucgacacauacacccacuacauccucgaaaacaacaaagucgaaauguucaucaacgacaaagaagacuccgcaccgcuccuccccgucaucgaagacgacagguacguuguuaagaccauccccagcugccgaauguccacgcuugaaauacccgccauggccuuccacauguuccuauucgguuccaaaaagacagaaaagcucaucguagauguacacaacagauauaaacgccucuuccaagccaugcagaaagaagaagucacugcugaaaacaucgcauccuucggcaucgcagaaucggaucuaccccagaaaauacucgaccucaucuccggcaacgcacauggcaaagacguggacgccuuuauacggcuaaccgucgacgacaugcugaccgacaccgaacggagaaucaagcgcuucaaagaugacaggaaaucuauuagauccgcggacaacaaaaugggcaagcgcggcuuuaaacaaaucaguacaggcaaacucgcggacuuccuugcgaaagacaucgugcuauuccaacccuccgucaaugauggcgaaaacaaaaucacgggucuaaacuaccgaaucaugcagagcgcaaucgcgguguacgacagcggggacgacuacgaagcaaagcaacaauuuaaacucauguucgagaaggcccgccucaucggaaagggcacgaccgagccccacccauuccuguacaagguauucgcacgcuccauacccgcaaaugccguggaguucuacgaacgguaccuaaucgaaagaaaauucuaccuaaccggccuauccaacgaaaucaagaagggaaacagaguagacgucccuuuuaucagacgggaccaaaacaaauggaaaaccccugcaaugaaaacccuaggucgaauauacucggaagaccuaccugucgaacuaccaagacagauguucgacaacgaaaucaagagccaccucaaaagccucccacaaauggagggcauagacuucaacaacgccaacgucacauaucugaucgcagaguacaugaaaagaguccucgaugacgacuuucagaccuucuaccaauggaaccgaaacuacagauacauggacaugcucaaaggcgaauacgaccgaaagggcucccuacagcauugcuucaccuccgucgaagaacgcgaagggcucuggaaagaacgcgcuuccagaaccgaacgauaccgcaaacaagcgagcaacaagauccgcucaaacaggcaaaugagaaaugcgagcagugaagaaauagaaacaauacucgacaaacgccuuucaaacucacgcaacgaauaucaaaaaucggaaaaagugauccgucgcuacaggguucaggacgcacuccucuuucuccucgcuaagaaaacacucacggagcuugcggacuucgacggcgagcgcuucaaacucaaagagauaaugccagacgccgaaaaaggaauccugagcgagauuaugccaaugagcuucacuuucgagaagggaggcaagaaauacacaauaacuuccgaagggaugaaacugaaaaacuacggcgacuucuucguccucgcgucugacaaacgcauaggaaaccugcuggaacucgugggguccgacaucgucagcaaagaagacauaauggaagaguucaacaaauacgaccagugccgacccgagaucucgagcaucguauucaaccucgaaaaaugggcauucgacacuuacccugaacucucggcacguguagaccgcgaagaaaaaguagacuuuaagucaauacuaaaaauccuacuaaacaacaagaacaucaacaaggagcagagcgacauccucaggaaaauacgaaacgcauucgaccacaacaauuacccggacaaaggagucgucgaaaucaaagcccucccagaaauagccaugucaauaaagaaagccuucggugaauacgcuauaaugaaaggcagccuacaacuacccccgcuggaacgccugacucucgggucuucauaccccuaugauguccccgacuacgcauacccguacgacguacccgacuacgccuaccccuaugauguacccgacuacgccuga

SEQ ID NO: 14443 - RNA, 2748 nt, Artificial Sequence
  Cas13d variant__Gut metagenome assembly P1E0-k21__P1E0Cas13d-HA
auggagcgcgaagucaagaaaccaccaaagaaaagccucgccaaagcggcuggccuuaaaucuaccuucgucaucucuccacaagaaaaagaacucgcaaugacagccuucggacgugggaacgacgcccuccuacaaaaacgcauagucgacggaguaguccgagauguagcaggcgaaaaacaacaguuccaagugcaaagacaagacgaaucucgcuuccgccuucaaaacagccgguuagcagaccgcaccgucacagcagacgacccucuacauagagccgagacaccccgacgacagccacugggggcugguauggaucaauuacggcgcaaagccaucuuagaacagaaauacuucggacgaaccuucgacgacaacauacacauccaacuaaucuacaacauccuagacauacauaaaauguuagccguccccgcuaaccauaucguacacaccuugaaccuucucgggggauacggcgaaaccgacuucgucggcaugcucccggcaggcuuacccuacgacaaacuaagaguaguaaagaagaaaaacggcgacaccguagacauaaaagcagacaucgccgccuaugccaaacggccccaacucgccuaccucggcgccgccuucuacgaugucacucccggaaaaucaaaaagagacgccgcccggggaagaguaaaacgcgaacaagauguauacgccauucucucccucaugucacuccugcgacaauucugcgcgcacgacuccguccgaaucuggggccaaaacacaaccgcagcccuuuaccaccuucaagcgcucccgcaggacaugaaagacuuacuagacgacggcuggcgucgagcacuaggcgggguaaacgaccacuuucucgacacaaacaaaguaaaccuacuuacccuauucgaauacuacggagcggagacaaaacaagcccgcguugcgcucacccaagacuucuaucgauucguaguccucaaagaacagaaaaauauggguuuuagccuucgacgccuacgcgaagaacuccucaaacuaccagacgccgccuaccuaacaggccaagaauacgacagcgucagacaaaaacucuacaugcuccuggacuuccuacuaugucgacucuacgcccaagagagagccgacagaugcgaagaacugguaagcgcucuacggugcgcacuaagcgacgaagaaaaagacacugucuaccaggcggaagcagcagcccucuggcaggcgcuuggagacacacuccgcaggaaacuccugccacuacucaaaggcaagaagcugcaagacaaagacaaaaagaaaucagacgagcugggacuuagccgagacguacuagacggcguccuguuccggcccgcccaacagggcucacgcgccaacgccgacuacuucugccgucugaugcaccuaucaaccugguucauggacggcaaagaaaucaacacccuccucacaacccuaaucucaaaauuagaaaauauugacucccuccguuccguacucgaaagcaugggacucgcauacucuuucguccccgccuacgccauguuugaccacagucgauauauugcaggccaacuccgaguggucaauaacauagcccggaugagaaaaccagcgaucggcgcuaaacgagaaauguaccgagccgccgucguacuccucggcgucgacucaccugaagccgcagccgccaucacagacgaccuccuucaaaucgaccccgagaccggcaagguacgaccccgcagugacuccgcacgcgacaccggccugagaaacuucaucgccaacaacguagucgaaucccgccgcuucacuuaccuacuccgauacaugacaccugaacaagcccgaguccucgcacagaacgagaaacuaauagccuuuguacucuccaccgucccagacacccaacuugaacgguacugucgcacaugcggccgggaagacauaacgggccgaccagcccaaauccgauaccucacugcccaaauaaugggaguccgcuacgagagcuucacagacguugaacaacgcgggcguggagacaacccgaagaaggaacgauacaaagcccuuauaggccucuaccuaaccguacucuaccucgcggugaaaaacaugguaaauugcaacgcccgguacguaauagccuucuacugcagagaccgcgacacagcccuauaccaaaaagagguaugcugguacgaccuggaagaagacaagaaauccggcaaacaaagacaaguagaggacuacacggcacuaacccgauacuucgucucgcaaggauaccuaaaccgccaugcgugcggguaccucagguccaacaugaacggcaucuccaacucgcuccucacagcauaccgaaacgcugucgaccaccucaacgccauuccacccuuaggcucacuaugccgcgacauuggcaggguagacucauacuucgcgcuguaccacuacgcaguucaacaauaccucaacggccgguacuaucgcaagacacccagagaacaagaacuauucgcagccauggcacaacaccgaacauggugcagcgaccucgucaaagcacucaacacgccauucggguacaaccuagcccgcuacaaaaaccucuccaucgacggacucuucgaucgagaaggagaccacguuguccgagaggacggcgaaaaaccagccgaguacccauacgacguacccgacuacgccuga

SEQ ID NO: 14444 - RNA, 2748 nt, Artificial Sequence
  Cas13d variant__Gut metagenome assembly P1E0-k21__dP1E0Cas13d-HA
auggaaagagaaguuaagaaaccacccaagaaaucacuagccaaagccgccggccugaaauccaccuucgugaucagcccccaagagaaggaacucgccaugacugcauucggcaggggcaaugacgcccuccuucaaaaacgaauaguagacggaguuguacgagacgucgccggagaaaaacaacaauuccaaguccaacgccaagacgaaucccgcuucagacuccaaaacucucgucucgcagaccggacggugaccgccgacgacccacuccacagagccgagaccccucgaagacaaccacucggcgccggaauggaccaacuucgccgcaaagcaauccuggaacaaaaauacuucggccgcaccuuugacgacaacauucacauacaacugauuuacaacauacuagacauccauaaaaugcuggcagucccugcgaaccacaucguccacacccucaaccuacucggagguuauggugaaaccgacuucgucggcaugcuccccgcaggauuacccuaugacaaacugagggucgucaaaaagaaaaacggagacaccguggacaucaaagcggacauugcagccuacgccaaaaggccgcaacuggccuaccucggugccgccuucuacgacgucacgcccgggaaaucaaaacgagacgccgcacggggcagagucaaaagagaacaagacgucuacgcaauacucucacugaugucccuccuugcacaauucugugccgccgacucgguacguaucuggggucaaaacaccacggccgcccucuaccaccuccaagcucucccccaagacaugaaagaccuacuagacgacggcuggcgacgagcgcuuggcggcguaaaugaccauuuccuugacaccaacaaaguuaaccuccuuacacuuuucgaauacuacggggccgaaacaaaacaagcccgagucgcacuaacacaggacuucuacagauucguaguucucaaagaacagaaaaacaugggcuuuucucuucgccgacucagagaggagcuccucaaacuacccgacgccgccuaccuaaccggccaagaauacgacagcguacgucaaaagcucuacaugcuacucgacuuccuacucugucgucucuacgcucaagaacgggccgaccgaugcgaggagcucguuucagcauuacgcugcgcgcuaucggacgaggagaaagacaccgucuaccaagcagaagccgcagcccuauggcaagcacuaggcgacacccuacgccguaagcuauuaccccuacuaaaaggcaagaaacuacaagacaaagacaaaaagaaauccgacgaacuugggcucucccgagauguacuggacggaguucuauuccggccagcccaacaaggcagcagagcaaacgcggacuacuucugucggcuaaugcaccucagcacaugguucauggacggaaaagaaaucaacacccuacucaccacccucauauccaaacuugaaaauauugacucacuucgcagcgucuuggagagcaugggacuagccuacucguucguacccgcguacgcaauguucgaccauagcagauacauagcgggucaacuucgggucguaaacaacaucgccagaaugcgaaaaccagccaucggcgccaagcgcgaaauguaccgagccgccgucguccugcuaggcguggauagccccgaggcugcagccgccauaacagacgaccuccugcaaaucgacccagaaacugguaaagucagaccacgcucagacuccgcacgggacaccggucuacgaaacuucaucgcaaacaacguaguagaaucccgucgauuuacauaccuacuccgguauaugaccccagagcaagcaagaguccucgcccaaaacgagaaacugauagcauucguacuauccaccguaccagacacccaacucgaacgcuacugccgcacuuguggccgcgaggacauuaccggccgccccgcgcaaaucagauaccucaccgcccaaauaaugggaguccgauacgagagcuucacugacgucgaacaacgaggccgaggagacaacccuaagaaagaacgauacaaagcacucaucggccuguaccuuaccguacuuuaccuugccgucaaaaauauggucaacugcaacgcacgguacguaauagccuucuacugccgcgaccgagacacagcccucuaccaaaaagaagucugcugguacgaccuagaagaagauaagaaaagcggcaaacaacgccaaguggaagacuacacagcccuaacccgcuacuucguaucacaaggauaccuaaaccgccacgccugcggauaccuccgaucuaacaugaacggcaucagcaacagccuacucaccgcauacgccaacgccguugacgcccucaacgccauuccgccacuaggcucacuuugccgcgacaucggacgaguagauucauacuucgcacucuaccacuacgcuguccaacaauaccucaauggacgcuacuaccgaaaaacaccacgagaacaagaacuguucgcugccauggcacaacaccgcaccuggugcagcgaccuaguaaaagcccuaaacacucccuuuggcuacaaccucgcacgguacaaaaaccucagcaucgacggucuauucgaccgagaaggcgaccacguaguaagagaagauggcgaaaaacccgcugaauacccuuaugacguacccgacuacgccuga

SEQ ID NO: 14445 - RNA, 2820 nt, Artificial Sequence
  Cas13d variant__Gut metagenome assembly P1E0-k21__NLS-P1E0Cas13d-NLS-HA
augucccccaaaaagaaacggaaagucgaagccagcgagcgcgaagucaagaaaccaccaaagaaaucgcucgcgaaagccgccggacuaaaaucaacauucgucauaucaccacaggaaaaagaacucgccaugaccgcauuuggccgagggaacgacgcgcuacugcagaaaagaaucguagacggagucgugcgcgacguagcgggcgaaaaacaacaauuccaaguccaaaggcaagacgaaucaagauuccgacuccaaaacucacgacucgccgaccgaaccgucaccgcagacgacccccuccaccgcgcagagacaccccgccgccaaccacucggcgcagguauggaccaauugcggcgcaaagcaauccucgagcaaaaauacuucggccggacauucgacgacaacauacacauacaacuaaucuacaacauccucgauauacacaaaauguuggcaguaccagcgaaccacaucguucacacccuuaacuuacugggcggcuacggcgaaaccgacuucgucggcaugcuaccggcgggucuccccuacgacaaacuccgcguggucaaaaagaaaaacggugacacagucgacauuaaagcagauauugcagcauacgcaaaacgcccgcaacuugccuaccucggcgccgcguuuuacgacguaacacccgguaaauccaaacgugacgccgccagaggccgggucaaacgagaacaggacgucuaugccauccucagcuuaaugucacuacuaagacaguucugcgcgcacgacuccgugcgcauauggggacaaaacacaaccgccgcgcucuaccaucugcaagcacucccccaagauaugaaagaccuacucgacgacggauggcggcgagcccucggcggcgucaacgaccacuuccucgauacaaacaaaguaaauuuacuaacacucuucgaauacuacggcgcagaaaccaaacaagcgagaguggcccuaacacaagacuuuuacagguucguaguccuaaaagaacaaaagaacaugggauuuucccuacgccgacuccgcgaggaacuguuaaagcuaccagaugccgcguaccucaccggccaagaauacgacagcguacgccaaaagcuauacaugcuacuagacuuccuccucugccgacucuacgcccaagaaagagcagaccgaugcgaagaacugguauccgcccuccgaugcgcgcuaucggaugaggaaaaggacaccguauaccaagcagaagcggcagcucuauggcaagcccucggcgacacgcuacgccgcaaacuacucccccuccucaaaggaaagaaacugcaagacaaagauaaaaagaaaucagacgagcugggccucuccagggacguccucgacggaguucucuuuagacccgcccaacagggcucccgggccaacgcagacuacuucugucgccuaaugcaccucucaacaugguucauggacggaaaagaaaucaacacacuccuaaccacacuaauaucuaaauuagagaacauagacagccuacgcuccguucuagaaucgaugggauuagcguauucuuucguccccgcauacgccauguucgaccacucacgauacauugcaggccagcuucgaguaguaaacaauaucgcccggaugcgaaaaccagccauaggagcaaaacgugaaauguaccgcgccgcaguaguacuccuagguguagacucaccggaggccgcugccgccaucacggacgaccuccuacaaauagaccccgagacaggaaaagucaggccacgaagugacagcgcccgcgacaccgggcugagaaacuucauagcgaacaaugucgucgagagcagaagauuuacguaccugcuccgcuacaugacaccagaacaagccagaguccuagcacagaacgaaaaacugaucgcguucgugcucuccaccgucccagauacccaacuggaacguuacugcagaaccugcggucgcgaagacaucaccggcagacccgcucagaucagauaccucaccgcacaaauuaugggcguccgauacgaaucauucacagacgucgaacaaagaggacgcggcgacaaccccaagaaagagcgcuacaaagcacucauaggccucuaccuuaccguacucuaccuagccgucaaaaacaugguaaacuguaacgcuagguacguaauagcuuucuacugcagagaccgagacacagccuuguaccagaaagaagucugcugguacgaccuugaagaagacaagaaaucaggcaaacaacgccaagucgaagacuacaccgccuuaacccgauacuucgucucacaaggcuaccuuaaccgacacgccugcggauaccucagauccaacaugaacgguauauccaacucgcuacucaccgcauaccggaacgcaguggaccaccuaaacgcaauaccgccccugggcucccucugccgcgacauaggcagagucgacuccuauuuugcccuguaccacuacgccguccaacaguaccugaacgggcgcuacuaccgcaaaaccccaagagaacaggaacuauucgccgccauggcgcagcacagaaccuggugcagcgaccucguaaaagcacuaaacacaccguucggauacaacuuggcgagauacaaaaaccucagcauagacggacucuucgaccgagaaggagaccacguaguccgagaggacggcgaaaaaccugccgaaggcagcggaccuaaaaagaaaaggaaaguugccgcagccuacccauacgacguaccagacuacgcuuga

SEQ ID NO: 14446 - RNA, 2820 nt, Artificial Sequence
  Cas13d variant__Gut metagenome assembly P1E0-k21__NLS-dP1E0Cas13d-NLS-HA
augagcccaaagaagaaacgaaaagucgaagccuccgagcgcgaagucaagaaaccgcccaagaaaucccuagccaaagccgcaggacuaaaaucaaccuucgucauaucgccccaagaaaaagaacuggcaaugaccgcauucgggcgaggcaacgacgcccugcuacaaaaacgaaucguagacgggguuguccgagaugucgcgggcgaaaaacaacaauuccaaguacagaggcaagacgaaagcagguuucgccuacaaaacagcagacucgcagaccgcacggucaccgccgacgauccccuccaccgcgccgagacacccagaagacaaccccucggugccgggauggaccaacuccgcaggaaagccauccuagaacaaaaauacuucggccgcacauucgacgacaacauccacauccaacuaauauacaacauccucgacauccacaaaaugcuagcaguccccgcaaaccauauaguacacacccucaaucugcuaggcggcuacggcgaaaccgacuucgucgggauguugcccgcaggccuacccuacgacaaacuucgcguagugaaaaagaaaaacggcgacacagucgacauaaaagcggacauagccgcguaugccaaacgcccccaacuagcauaccuaggagccgcauucuacgacguuacccccgguaaaagcaaacgggacgcagcacgaggccgagucaaacgcgaacaggaugucuaugccauccucucacucaugagccugcucgcacaauucugugcugccgauagcgucagaaucuggggucaaaauacaacagcagcccucuaucaccuucaggcccuaccccaagacaugaaagaccuccuagaugacggauggcgcagagcccucgggggugucaacgaccacuuccucgacaccaacaaggucaaccuccucacccucuucgaauacuacggcgcagaaacgaaacaggcgcguguagcccuaacacaggauuucuaucgguucgucgugcucaaggaacagaaaaacaugggcuucucccuccgccgccuccgggaagaacuacucaaacuccccgacgcagcauaucuaaccggacaagaauacgauagcguccgccaaaaacuguacaugcuacucgacuuccuacucugucgccucuaugcacaagaacgagccgaccgaugugaagaacuggucagcgcacuaagaugcgcacugucagacgaggaaaaggacacagucuaccaagcggaagccgcagcucucuggcaagcauuaggagacacacucaggcguaaacuccucccccuccuaaaaggcaagaaauuacaggacaaagacaaaaagaaauccgacgaacucggccuaucaagagauguacucgacggaguacucuucagaccggcgcaacagggcagccgggcgaaugcagacuacuucugucgccuuaugcaccuuuccaccugguucauggacggcaaagaaaucaacacacuccuaaccacauugauaucuaaacuggagaauauagacagucuccgcucaguccucgagagcaugggccucgcguacucguucguaccagcauaugcgauguucgaccacucccgcuacaucgcgggccaacuccgcgucguaaacaacaucgcucgcaugcggaaaccagcuauaggagcgaaacgagagauguacagagccgccgucguacuuuuaggcgucgacucccccgaagcugccgccgcaauaacagaugaccuacugcagaucgacccagaaacagguaaagugcgcccaagguccgacucugcacgggacacaggacuaagaaacuucauagcuaauaacguaguagaaucacguagguucacguaccuacuccgauauaugaccccagaacaagcccgaguacuugcccaaaaugagaaacucaucgcauucgugcucuccacugugccagacacccaacuagaacgauacugcaggacuuguggcagggaggacauaaccggacgcccagcgcaaauacgcuaccuaacggcccagaucauggguguucgguacgaauccuucacagacguagagcaacgaggcagaggggauaaccccaagaaagagcgcuacaaagcccuaaucggccucuaccuaaccgucuuauaccuagcagucaaaaacaugguaaacugcaacgcccguuacgucauugcauucuacugccgcgaccgagacacggccuuauaccaaaaagaagucugcugguacgaccuggaagaagacaagaaaucaggcaaacagcgacagguggaagacuacacagcccucacccgcuacuucgucucacaagguuaccucaaccgccacgcaugcggcuaccugaggucuaacaugaacgggauuaguaacucacuccuaaccgcauacgccaacgcaguagacgcacuaaacgcaaucccaccucuaggaucacuuugccgugacauagggcgcgucgacucuuacuucgcucucuaccacuacgcaguacagcaauaccuaaacggccgauacuaccgcaaaaccccaagagaacaagagcuauucgcagccauggcccaacaucgcacaugguguagcgaccuagucaaggcccuuaacacaccguucggauacaacuuagcacguuacaaaaaucugucaauugacggccuauucgaucgagaaggcgaccacgucguccgagaagacggggaaaaacccgccgaaggcucuggcccuaagaagaaaagaaaagucgccgccgccuaccccuaugauguuccggacuaugccuga

SEQ ID NO: 14447 - RNA, 2862 nt, Artificial Sequence
  Cas13d variant__Ruminococcus albus __RaCas13d-HA
auggccaaaaagucgaaggggaugucgcuccgggagaagcgugaacuggaaaaacaaaaacgcauccagaaggcagcagucaacucagucaaugacaccccagaaaagacagaagaagccaacgucgucagcguaaacguacgcacaucagcggaaaacaaacacucaaagaaaucagcugccaaagcccuaggucucaaauccggccuagucaucggugacgagcuauaucucacgagcuucggccgagguaacgaagcaaaacucgagaaaaagaucuccggagacacagucgaaaaauugggcaucggcgccuucgaagucgccgaacgagacgaauccacgcugacccuagaaagcggccgcaucaaagacaaaacggcacgccccaaagacccccgucacaucacagucgacacacaaggcaaguucaaggaagauaugcucggaauccgcagcguacuugaaaagaaaauauucggcaaaacauucgacgacaacauccacguccaacucgccuauaacauacuggacguggagaaaaucauggcgcaguacguaucggauauaguauacaugcuccacaauaccgacaaaacugaacggaacgacaacuuaaugggauauaugucuaucagaaacacuuacaagaccuucugcgacaccagcaacuuaccagacgacaccaaacaaaaaguagaaaaccaaaaacgcgaauuugacaaaaucaucaaaagcgggagacucggauacuucggcgaagccuucauggucaauucaggcaacucuacaaaguuaagaccagaaaaagaaauauaccacaucuucgcucuaauggcaucccuccgacaaagcuacuuccacggguacgucaaagacaccgacuaccaagguacaacuugggccuacacccucgaagacaagcugaaaggacccucccacgaguucagagagaccaucgauaaaauauucgacgaaggguucaguaagaucagcaaagacuucgggaaaaugaauaaaguaaaccuccagauccucgaacaaaugaucggggaacuguacgggucgauugaacgucagaaucucacaugcgauuacuacgacuucauacaacucaagaaacacaaauaccuaggauucagcauaaaaagacuccgagaaacgaugcucgaaacaacaccggccgaaugcuacaaggcagaaugcuacaacagcgaacgacagaaacuauacaaacucaucgacuuccucaucuacgaccucuacuacaaccggaaaccagcacgcauagaagaaauagucgauaaacugcgggaaagcgucaacgaugaggagaaagagucgauauacucgguggaggccaaauaugucuacgaaagccucagcaaagugcucgacaaaagccuuaaaaacagcgugagcggagaaacuaucaaggaccuacagaaacguuacgacgacgaaaccgcaaaccgaauaugggacaucagccaacacucgauauccggaaaugucaacugcuucugcaaacucauauauaucaugacccucaugcuagacggaaaagaaauaaacgaucuccuaaccacauugguaaacaaauucgacaacauagccagcuucauagacguuauggacgaacugggccucgagcacucguucaccgacaacuacaaaauguucgcagacagcaaggcuaucugucuagaccuccaauucaucaacagcuucgcacggauguccaaaaucgacgacgaaaaauccaaacgacaacucuuccgagacgcacuggucauacuggacauuggcaacaaggacgaaacguggaucaacaacuaccuagacuccgauauuuucaaacuagacaaggaaggcaacaaacuaaaaggcgccaggcacgacuuccguaacuucauugcaaauaacgucaucaagaguucccgguucaaauaccucguaaaauacucuuccgcagacggaaugaucaagcucaagacgaacgaaaagcucaucggauuugucuuagacaaacuacccgagacccaaaucgaccgguacuacgaaucaugcgggcucgacaacgcugucgucgacaaaaagguaagaaucgaaaaacuauccggccugauccgcgacaugaaguucgacgauuucuccggaguaaaaacauccaacaaagccggcgacaacgacaagcaagacaaagcaaaguaucaagccaucaucagccuguaucucaugguccuguaccaaauugucaaaaacaugauauacgucaacucccgauaugucauagcguuccacugccuggaacgagacuucgggauguacggcaaagacuucggcaaauacuaccaaggcugccguaaacuaacagaccacuucaucgaggaaaaauacaugaaagaaggcaaacuaggauguaacaaaaagguaggccgcuaccugaaaaauaauaucucaugcuguaccgacggccucaucaauacauacagaaaccagguagaccacuucgccgucgugcgcaagauaggaaacuacgccgccuacaucaaaucgaucggcucaugguucgaacucuaucacuacgugauccaacgaaucguguucgacgaguaccgcuucgcucucaacaacaccgaaagcaacuacaagaacagcaucaucaaacaucacaccuacugcaaggacauggugaaagcacucaacacaccauucggauacgaucugccccgauacaagaaccugucaaucggagaccuauucgaccgaaacaacuaccucaacaagacgaaagagagcaucgacgccaacuccucaauugacucgcaauaucccuacgacgucccggacuacgcguga

SEQ ID NO: 14448 - RNA, 2934 nt, Artificial Sequence
  Cas13d variant__Ruminococcus albus __NLS-RaCas13d-NLS-HA
augagcccaaagaaaaagcguaaaguggaggccucagcaaagaagucgaaggggaugucgcucagagagaaacgcgagcuagagaaacagaagcgcauccagaaagcagcagucaacucagucaacgacacccccgaaaagaccgaagaggccaacgucgugagcgugaacgugcgcaccagcgccgaaaauaaacacucaaagaaauccgccgccaaagcucucggccuaaaaagcggccuugugauaggcgacgaacuauaccucaccuccuucgggcgaggaaacgaagcgaaacucgagaagaaaauaucaggcgacacugucgaaaaacuaggaaucggggcguuugaaguagccgaacgagacgaaagcacccucacccucgaaucaggccgaauaaaagacaaaaccgcacggccaaaagacccacgccacaucaccguagacacccaaggaaaauucaaagaagacaugcuagguaucagaucgguccuagaaaagaaaaucuucgguaagaccuuugacgacaacauucacguccaacuagcguacaacauccuagacgucgagaaaaucauggcacaauacguguccgacauagucuauaugcuacacaacaccgacaagacugaacgaaacgacaaucuuaugggcuacaugucgauccggaacacauacaaaacauucugcgacacguccaaccuuccggaugacacgaaacagaaagucgaaaaccaaaagcgcgaguucgacaaaaucauaaaaagcggacgauugggcuauuucggcgaagcguucaugguaaacagcgguaacagcaccaaacuccgaccagaaaaagaaauauaucacauauucgcgcuaauggccagcuuacgacaauccuacuuccacggcuacgucaaggauacagacuaucagggcacaacgugggcguauacgcuagaggacaaacuaaaaggcccaucccacgaguuccgcgaaacaaucgacaaaauauucgacgaaggauucaguaaaaucagcaaggauuucggaaaaaugaacaaagucaaccuccagauacucgaacaaaugaucggcgaacuauauggauccauagaacgacaaaaccucacaugcgacuacuacgacuucauacaacuaaagaaacacaaauaccucggguucagcaucaaacggcuccgagagaccaugcuugaaacgacucccgcagagugcuauaaagcggaauguuacaacucagaacggcagaaacuguacaaacuaaucgacuuccuuaucuaugaccucuacuacaaccgcaaaccagccaggauugaggaaaucguagacaaacuacgcgagagcguuaacgacgaagaaaaggaguccaucuacagcgucgaagccaaguaugucuacgagucccucuccaagguccucgauaaaucacucaaaaacaguguauccggcgaaaccauaaaagaccuacagaaacgcuacgaugacgaaacggcaaacaggaucugggacaucucacaacacuccauaagcgggaacgucaacugcuucugcaaacugaucuacauaaugacccugaugcuggacgggaaagaaaucaacgaucuccuaaccaccuuaguuaauaaauucgacaacaucgcauccuucaucgacgucauggacgaacucggccuagagcacaguuucacugacaacuacaaaauguucgccgacucaaaagcaaucugccuagaccuccaauucaucaacagcuucgcccgaaugucuaaaaucgacgacgagaaaagcaagcgccaacuauuccgcgacgcccuagucauccucgacauuggcaacaaagacgaaacauggauuaauaacuaccuagacagcgacaucuucaagcuggacaaggaaggaaauaaacuaaagggcgcacggcacgacuuccgaaacuucaucgcgaacaacgucauuaaaagcucccgcuucaaauaccucgucaaauacucauccgccgacggaaugauaaaacuuaaaacaaacgaaaaacuaaucggcuucgugcuggauaaacucccagaaacacaaauagaccgauacuacgagucuugcgguuuagacaacgccgucguagacaagaaaguacggaucgaaaaacucagcgggcucauccgagacaugaaauucgaugacuuuucgggagucaaaaccucaaacaaggccggcgacaacgacaaacaagacaaggcgaaauaccaagccaucauaucucuauaucuaauggugcucuaccaaaucgucaaaaacaugaucuacguaaacagccgguacgucauagccuuccacugccuggaacgcgacuucggcauguacggaaaggacuucggcaaauacuaccaaggcugccggaaacucacagaccacuucaucgaggaaaaauacaugaaggagggaaaacuaggaugcaauaagaagguagguagguaucugaaaaacaauauaucauguugcaccgacggucuaaucaacaccuacagaaaccaaguagaccacuucgcagugguacgaaaaaucgguaacuacgcggcguacauaaaaagcaucggcucgugguucgaacuguaccacuacgucauccaacggaucguauucgacgaauaccgcuucgcacucaacaacaccgagucgaacuacaaaaacucaaucaucaagcaccacacuuacugcaaagacaugguaaaagcacucaacaccccauucggcuacgaccuaccccgauacaagaaucucagcauuggcgaccucuuugaccgaaacaacuaccuaaauaaaacaaaagaaagcaucgacgcaaacagcagcaucgacagucagggcuccggcccuaaaaagaaacgcaaagucgccgcagcguaccccuacgacgugcccgauuacgccuga

SEQ ID NO: 14449 - RNA, 2829 nt, Artificial Sequence
  Cas13d variant__Ruminococcus flavefaciens FD1__RffCas13d-HA
augaaaaagaaaaugucgcuccgcgaaaaacgagaggcagaaaaacaagccaagaaagcagcauauucagcggcaagcaaaaacacugacuccaaacccgcugagaagaaagcggaaaccccgaaacccgcagaaaucaucagcgacaacucccguaacaaaacagccguaaaagccgcaggucucaaaagcaccauaaucucaggcgacaaacuauacaugacuuccuucggaaaaggaaacgccgcgguaauagaacagaaaauagacaucaacgacuacagcuucuccgcaaugaaagauacacccagccuagaagucgacaaagccgagagcaaagaaauaucauuuuccagucaccacccuuucgucaaaaacgauaaacuuaccaccuacaacccacucuacggcggaaaagacaacccagaaaaacccguggggcgcgacaugcugggucucaaagacaaacucgaagaacgguacuucggcugcacuuucaacgacaaccuccacauucagauaauuuacaacauccuggacauagagaaaauacucgcaguucacuccgcaaacauaaccacugcccuggaccacaugguagacgaagaugacgaaaaauaccuaaacuccgauuacaucggcuacaugaacacaaucaacacuuaugacguauucauggaucccuccaaaaacucuagccuuuccccaaaagacagaaagaacaucgacaacucacgagccaaauucgaaaaacuacucuccaccaaacgccucggauacuucggcuucgacuacgacgcaaacgggaaagacaaaaagaaaaaugaagaaaucaagaaacgacuguaccaccucaccgccuucgccggccaacuacgccaaugguccuuccacucagccggcaacuacccccgaaccuggcucuacaaacuugacucccuagacaaagaauaccuggacacccucgaccacuacuucgacaaacguuucaacgacaucaaugacgacuucguuaccaaaaacgcaacgaaccucuacauccucaaagaagucuucccggaagcgaauuucaaggacauagccgaucucuauuacgauuucauagucaucaagucccacaaaaacaugggauuuuccauaaagaaacuacgagagaaaaugcuagaaugcgacggagccgaccgaaucaaagaacaagacauggacuccguccgcuccaaacucuacaaacuaaucgacuucugcauauucaaauacuaccacgaguuccccgaacuauccgaaaagaacgucgauauucuccgcgccgccguaucagacaccaagaaagacaacuuguacagcgaugaagcggcacgccuaugguccaucuucaaagaaaaauuucucggguucugcgacaaaauaguaguaugggucaccggagaacacgagaaagacauaaccucagucauugacaaagacgccuaccggaaccguagcaauguuucauacuucuccaaacucauguacgccaugugcuucuuucuagacgguaaagagauaaacgaccucuuaacaaccuuaaucaacaaauucgacaacaucgcaaaccaaaucaagaccgcaaaagaacucgggauuaacacagcauucgucaaaaacuaugacuucuucaaccacucagagaaauacguagacgagcucaauaucgucaaaaauaucgccagaaugaagaaacccucaagcaacgcaaagaaagccauguaccacgaugcccucacgauccuaggcauacccgaagacauggacgagaaagcccucgaugaggaacuagaucuuauccucgagaagaaaacagaccccguaaccggcaaaccgcuuaaagggaaaaacccccucaggaauuucauagccaacaacguaauagaaaacagccgcuucaucuaccugaucaaauucugcaacccggagaacgugcgaaaaauagucaacaacacgaaagucacagaguucguacucaaacgaauaccagacgcgcaaauagaacgcuacuacaaaucgugcacggacuccgagaugaacccacccaccgagaagaaaaucacugaacucgcugguaaacucaaagacaugaacuucggaaacuucagaaacguccgucaauccgccaaagaaaacauggagaaggagcguuucaaagcagucaucggccuauaccuaacaguagucuaccgcguagucaaaaaccuagucgacguaaacucccguuauauaauggcauuccacagccuagaacgagacucccaacuauacaacguuagcgucgacaacgacuaccucgcccuaacagacaccuuggucaaggaaggcgacaacuccaggucgcgcuaccuagcaggcaacaaacgccugcgggacugcgucaaacaggacauagacaacgccaaaaagugguucguaagugauaaguacaacucaaucaccaaauaccguaacaacgucgcgcaccuaaccgcagugcgcaacugcgcagaguucauuggagacauaaccaagaucgacagcuacuucgcgcuauaccauuaccucauacagcgccaacucgccaagggccuugaccacgaacgcucggguuucgaccgcaacuacccccaauacgccccgcuuuuuaaauggcacaccuacgucaaagacgucguaaaagcccuaaaugcaccauucggauacaauauaccccgauuuaaaaaccucucaauagacgcgcuauuugacagaaacgagaucaagaaaaacgacggggaaaagaaaucagacgacuacccauacgacgucccagacuacgccuga

SEQ ID NO: 14450 - RNA, 2901 nt, Artificial Sequence
  Cas13d variant__Ruminococcus flavefaciens FD1__NLS-RffCas13d-NLS-HA
augagccccaaaaagaaacgaaaaguggaagccuccaaaaagaaaauguccuugagagaaaaacgugaagccgagaaacaagccaagaaagcagcauacagcgccgccagcaaaaacacggacagcaagccagccgagaaaaaggccgagaccccaaaaccugcagaaaucaucucugacaacagccgaaacaagacagccgucaaagccgccggccuaaaauccacaaucauuuccggcgacaagcucuacaugaccagcuucggcaaaggcaaugccgcggucaucgaacagaaaaucgauaucaacgauuacagcuucuccgcgaugaaagacacacccucguuagaaguugacaaagccgagucuaaggagauaucauuuuccucgcaccacccauucgucaagaacgacaaacuaaccaccuacaacccccucuacggcgggaaggacaaccccgagaagccagucggccgcgacaugcuaggucucaaagacaaacuugaagaaagguauuucggcugcacuuucaacgacaaccuccacauacaaaucauauacaauauccuggauaucgagaaaauccuagcaguccacagugccaacaucacaacggcccucgaccacauggucgacgaagacgacgaaaaauacuugaacucagacuauaucggcuauaugaauaccauuaacacauacgacguuuuuauggaucccagcaaaaacuccucccugagccccaaggaccgaaagaacauagacaacagcagagcaaaauucgagaaacuccucagcacuaaacgccucggauauuucgguuucgacuacgacgcaaauggaaaagacaaaaagaaaaacgaggaaauaaagaaacgucuauaccaccucaccgccuuugccggccaacuacgccagugguccuuccacuccgcagggaacuacccccguaccuggcuauacaaacuagacagccuggacaaagaauaccucgacacacucgaccacuacuucgacaaacgcuucaacgacauuaacgacgacuucgucaccaaaaacgccacaaaccuauauauacuaaaagaagucuucccggaggccaacuucaaagacauagccgaucucuacuaugacuucauagugauaaaaucacacaaaaacaugggcuuuucaauuaagaaacuaagagagaaaaugcuggaaugcgacggcgcagaccgaauaaaagaacaggacauggauagcguccggucgaaacuauacaaacugaucgacuucugcaucuucaaauacuaccacgaguucccggaacuaagcgaaaagaacguagacauccuacgagcagccgugagcgacaccaagaaagacaaccuauacucugacgaagcagcacggcucuggaguaucuucaaagaaaaauuccuaggguuuugcgacaaaauagugguguggguuaccggagaacaugaaaaagacaucacaucugucauagacaaagacgcauaccgcaaccgaucuaacgucagcuacuucuccaaacucauguacgccaugugcuuuuuccuagacggcaaagaaaucaacgaucuacucaccacacuaauaaacaaauuugauaacauagccaaccagauuaaaaccgcgaaagaacuaggcaucaauacagccuucgucaaaaauuacgacuucuuuaaccacucugaaaaauacguagacgaacugaacaucgugaaaaacaucgcacgcaugaagaaacccuccaguaacgccaaaaaggcuauguaccacgacgcacuaaccauauuaggcaucccagaagacauggacgaaaaggcacuagacgaagaacucgacuuaauacucgaaaagaaaaccgaucccguaacggggaaaccacuaaagggcaaaaacccgcuaagaaacuucaucgccaacaacgucauagaaaacagccguuucaucuaccuuauaaaguucuguaaccccgaaaacguacgaaaaaucgucaauaacacuaaagucacagaguucguccugaaacgaauccccgacgcccaaaucgaacguuacuacaaguccugcacagacuccgaaaugaacccgcccacggaaaagaaaaucaccgaacucgccggcaaacuaaaggacaugaacuucggcaacuuccgcaacguacgccaauccgccaaagagaacauggaaaaggaacgcuucaaggcgguaaucgggcucuaccuaacagucguauacagaguagugaagaaccucgucgacgucaacucacgguacauaauggcauuccauagccucgaacgagacucucaacuauacaacguaagugucgacaacgacuaccuagcccuaacagacacgcucguaaaagagggagacaacagccgaucaagauaccucgccggcaauaaaagacuacgcgacugcgucaaacaagacaucgacaacgccaagaagugguuuguaagugauaaguacaauucaauaaccaaguacagaaacaacguagcgcaccucacagccguaagaaacugcgcagaguucaucggggacaucaccaagaucgacagcuacuucgcgcuuuaccacuaccugauacaacgccaacucgcuaaaggacuggaccacgaacgcagcggauucgaccgcaauuacccacaauacgccccacucuucaaguggcacacguauguaaaggacgucgucaaggcuuuaaacgcuccuuucggcuacaacaucccgcgcuuuaaaaaccugucaaucgacgcucuauucgaccgaaacgaaaucaagaaaaacgacggcgaaaagaaaagcgacgacggauccggccccaaaaagaaacggaaagucgcagccgccuacccauacgacguccccgacuacgcguga

SEQ ID NO: 14451 - RNA, 2931 nt, Artificial Sequence
  Cas13d variant__Ruminococcus flavefaciens XPD3002__RfxCas13d-HA
augaucgaaaagaagaaguccuucgcgaaagggaugggcgugaaauccacccuaguauccggcagcaaaguauacaugaccacauucgcagagggcuccgacgcccgccucgagaaaaucgucgaaggcgacuccauacggucaguuaacgaaggcgaagccuucagcgccgaaauggccgacaaaaacgcaggcuauaaaaucggaaacgccaaauucagccaccccaaaggauacgccgucgucgcaaacaacccccucuacacagggcccguacaacaagacaugcuaggucucaaggagacgcuagagaaacgguacuuuggcgaguccgccgacggcaacgacaacaucugcauacaagucauccacaacauacucgacaucgagaaaauacuagccgaauauaucaccaacgccgcauacgcuguaaacaauauauccggacucgacaaagacaucaucggcuucgggaaguuuucaacagucuauaccuacgacgaguucaaagacccagaacaccaucgcgcagccuucaacaauaacgacaaguuaauuaacgcgauaaaggcacaguacgacgaguucgauaacuuccucgacaaccccagacucggcuauuucgggcaggccuuuuucuccaaggaaggcaggaacuacaucaucaacuacggaaaugaaugcuacgacauccuggcguugcuaagcggccuccgucauuggguaguccacaacaaugaagaagaaucacgcaucagccguaccugguuauacaaccuggacaagaaccuagacaaugaguacaucuccacccucaauuacuuguacgacagaauaaccaacgaacuuaccaacuccuucucaaagaacagcgcagcgaacgucaacuacaucgcagagacccucggcauaaacccagcagaguucgccgaacaguacuuccgauucucaauaaugaaggaacaaaagaaccugggguucaacaucacaaaacugcgcgaaguuaugcuggaucgaaaggacauguccgagauccgcaaaaaccacaaaguauucgacuccauacgaacgaaaguuuauaccaugauggacuucgucaucuaccgcuacuacaucgaagaagacgcaaaagucgccgccgccaacaagagcuuaccagacaacgaaaagagccucucggaaaaggacauauucgucaucaaccuccgaggcuccuuuaacgacgaccaaaaagaugcgcuauacuacgacgaagccaaccgcauauggcgaaaacucgagaacauaaugcacaacauaaaagaguuccgaggcaacaaaacaagagaauacaaaaagaaagacgcaccgcgacuaccccggaucuuacccgccggaagagacguaagcgcauuuagcaagcugauguacgcgcugacgauguucuuagacggcaaagaaauaaacgaccuacucacaacccuaauaaauaaauucgacaacauccaaucauuccugaaaguaaugccacuaaucggcguuaacgccaaguuuguagaagaauacgcauucuucaaggacuccgcuaaaaucgcugacgaacugagacucaucaagagcuucgcccgcaugggggagccuaucgcagacgccagacgagcuauguacauagacgccauacggauccucggaaccaaccuaagcuaugacgaacuaaaagcucucgccgacacuuucucacucgacgaaaacggaaacaaacugaagaaaggaaaacauggcaugcgaaacuucaucaucaacaacguaauuucaaacaaaagauuucacuaccuaauccgcuacggugacccagcccaucugcacgaaauugcgaaaaacgaagcaguaguaaaauucguccucggaagaauagccgacauccagaagaaacaaggccaaaaugggaaaaaucaaauagaccgcuacuacgaaaccugcaucgggaaagacaaagggaaaucaguaucggaaaaagucgacgcccucacaaaaaucauaacaggcaugaacuacgaccaauucgacaagaaacgaucaguuaucgaagacaccggcagagagaacgcugagcgcgagaaauucaaaaagaucauuagccucuaccuuaccgugaucuaccacauacucaaaaacauaguaaacaucaacgcccgcuacguaauaggcuuccacuguguagaacgcgacgcccagcuauacaaagaaaaaggcuacgacaucaaccuaaagaaacucgaagaaaaaggauuuagcagcgucacaaaauuaugcgcaggcauugacgagaccgcaccagacaaaagaaaagacguagaaaaagagauggccgaacgcgccaaagaaagcauugacagucucgagagcgcaaaccccaaacucuacgcaaacuacauaaaauacucugacgagaaaaaggcagaagaguucacgcgacagaucaaccgagaaaaggcaaaaaccgcucucaacgccuaccuaagaaacaccaaguggaacgucauuauccgggaagaccuacugcgcaucgacaacaaaacuugcacccuauuccgcaacaaggccguccaccucgaagucgcccgcuacguucacgcauacaucaacgacaucgcagaagucaacuccuacuuccaacuauaccacuacaucaugcaacgcauaauaaugaaugaacgauacgaaaagucauccggcaaagucagugaauacuucgacgccgucaaugacgagaagaaauacaacgacagacuccuaaaacuacucugcgugccauucggauacugcauaccccgauucaaaaaccucuccauagaagcccuauucgaccgaaacgaagcagcgaaauucgacaaagagaaaaagaaggucucaggcaacuccuacccauacgacguccccgacuacgccuga

SEQ ID NO: 14452 - RNA, 2931 nt, Artificial Sequence
  Cas13d variant__Ruminococcus flavefaciens XPD3002__dRfxCas13d-HA
augauagaaaagaagaaaucguucgcgaaaggcaugggcgugaaauccacccuagucuccgggagcaaaguauacaugaccacauucgccgaaggaagugacgcaaggcuugagaaaauaguagaaggagacuccauccguucuguaaacgaaggagaagccuucagcgccgagauggccgacaaaaacgcgggcuacaaaauaggcaaugccaaauucucccaccccaaaggguacgccguggucgcaaacaacccccuguauaccggccccguccaacaagacaugcuagggcuuaaagaaacacucgagaaacgauacuuuggagaaagcgccgaugggaacgacaacaucugcauccaggucauccacaauauacucgacauagagaaaauauuagccgaauacaucacaaacgccgcguacgccgucaacaacaucagcggauuggacaaagauaucauaggguuuggaaaauucagcaccgucuacaccuacgaugaguucaaagacccagaacaccacagagcggccuucaacaacaacgacaaacuaaucaacgccaucaaagcacaauacgacgaguucgacaauuuccuagacaaccccagacugggauacuucggccaggcauucuucuccaaggaaggaaggaacuacaucaucaacuacggcaacgaaugcuacgacauccuagcccuccuaucaggccucgcgcacuggguaguagcaaacaacgaagaagaaagccgcaucucuagaacauggcucuacaaccuggacaaaaaccuagauaacgaauacauauccacgcucaacuaccucuacgacagaauaacaaacgaauuaacaaacucauucuccaaaaauuccgcagcaaacgucaacuacauagccgaaacccuaggcaucaaucccgccgaguucgccgaacaauacuuccgauucucaaucaugaaagaacaaaagaaccugggcuucaacaucaccaaacuuagagaagucaugcucgaccggaaagacauguccgaaauccgaaagaaccauaaagucuucgacucaaucagaacgaaaguuuacaccaugauggacuuugucaucuacagauacuacauagaagaagacgcuaaaguagccgccgccaacaaaagccucccagacaacgaaaaaucccuuucggaaaaagacauauucgucauaaaucuacgcggcucauucaaugacgaccaaaaagacgccuuauacuacgacgaagccaacagaaucuggcgcaaacucgaaaacauuaugcacaacaucaaagaauuucgugggaacaaaacgagagaauacaagaaaaaggacgccccacgacucccgcggauccugccggccggcagagacguuucagcuuuuucgaagcuaauguacgcacucaccauguuccuggacggaaaagaaauaaacgaccuccuuaccacgcugaucaacaaguucgauaacauacaaaguuuccucaaggucaugccacuaauaggcgucaacgcgaaguucguggaagaauacgccuucuucaaagauuccgccaaaauagccgacgaacugcgccucauaaaauccuucgcccgcaugggcgaacccauagccgacgccagacgggcgauguacauagacgccauccgcauccucggaaccaaccuauccuacgacgaacuuaaagcccuggccgacacauuuucacuugacgaaaacgggaacaaacugaagaaaggaaaacacggcaugcgcaacuucauaauaaacaacgugaucagcaacaaacgcuuccacuaccuuauaagauacggcgaucccgcacacuuacacgaaaucgccaaaaacgaagcaguagucaaauucguccucggccggauagcugacauacagaaaaagcagggucaaaacggcaagaaucagauagaccgguacuacgaaaccugcaucggcaaggacaaaggcaagagcgucuccgagaaaguggacgcacucaccaaaauaauaacgggaaugaacuacgaccaguucgacaagaaacgaucaguaauagaagacaccggccgugaaaaugccgaaagagaaaaauucaaaaagauaauuagccuauaccucaccgucaucuaccacauacugaaaaacaucguaaacaucaacgcccgcuacgucauaggcuuccacugcguagagcgagacgcccaacucuauaaagagaagggcuacgacauaaaccugaagaaacucgaagaaaaaggcuucaguucaguuacaaaacucugcgccggcauugacgaaacagcacccgacaaacgcaaagacguagaaaaagaaauggcugaacgggcgaaagaauccaucgauucgcuggaaagugccaacccaaagcuauacgcaaacuacauuaaauauagcgacgaaaagaaggcggaagaguucacccgccaaaucaaccgcgaaaaagccaagacggcccugaacgccuaccuccgaaacaccaaauggaacgucaucauccgcgaggaucuacuccgcaucgauaacaaaaccuguacacucuucgcaaacaaagcgguagcgcucgaaguggcucgguacguccacgccuauauaaacgacaucgccgaagucaacagcuacuuccagcucuaccacuacaucaugcaacggauaaucaugaacgagcgcuacgaaaaauccucgggaaaagugagcgaauacuucgacgccguaaacgacgaaaagaaauacaacgaccgacucuuaaaacugcucugugugccauucggcuacugcauaccccgauucaaaaaccucagcaucgaagcccucuucgaccgcaacgaagcggcaaaguuugacaaagagaaaaagaaagucagcggaaacucguacccauacgacgucccagacuacgccuga

SEQ ID NO: 14453 - RNA, 3003 nt, Artificial Sequence
  Cas13d variant__Ruminococcus flavefaciens XPD3002__NLS-RfxCas13d-NLS-HA (CasRx)
augucaccgaaaaagaaacgaaaagucgaagccaguaucgaaaagaaaaagucuuucgccaagggcauggggguaaaaagcacccuagucuccggcagcaaaguauacaugacaaccuucgcggaaggcagugacgcccgccuagaaaagaucgucgaaggcgacucuauaagguccgucaacgaaggggaagccuucucagcggaaauggccgacaaaaacgcaggguacaaaaucggcaacgccaaauucucacacccaaaaggcuaugcggucgucgcaaacaauccccuguacaccggcccgguacaacaagacaugcucggacuaaaagaaacccuagagaaaagauacuucggcgaauccgccgacgguaaugauaacaucugcauacaagucauacacaacauccucgacaucgagaaaauccucgccgaauacaucaccaacgccgcguacgccgucaacaacaucagcggccucgacaaagacauuaucggauucgggaaguucucuacaguguacacauacgacgaguucaaagacccugaacaccaccgcgccgcauucaacaauaacgacaaguuaauaaacgccaucaaagcccaguacgacgaguucgacaacuuccuagacaacccacgucucggguacuucggacaggccuucuuuucaaaagaagggcguaauuauaucaucaauuacgggaaugaauguuacgacauccucgcccugcuaagcggacuacggcacuggguaguccacaacaacgaagaagaaagccgcauaucccgcaccuggcucuacaacuuagauaaaaaccucgacaaugaauacauaagcacccucaacuaccucuacgaccgcaucaccaacgaacucacaaacuccuucucuaaaaacucugccgccaacgucaauuauaucgccgaaacgcuaggaaucaaccccgccgaauuugccgaacaauacuuccgcuucuccaucaugaaagaacagaaaaaucuuggauucaacaucaccaaacuccgagaaguaaugcuagacagaaaggacaugagcgaaauccggaagaaccacaaaguauucgacuccauccgcacuaaagucuacacaaugauggacuucguuauauaccgauacuacaucgaagaagacgcaaaaguggccgccgccaacaagucccucccagacaaugagaaaagccugagcgagaaagacauauucgucaucaaccuccgcggcucauucaacgacgaccaaaaagacgcacuauacuacgacgaggcaaaccgcauauggcguaaacuagaaaacaucaugcacaacaucaaggaguucaggggcaacaaaacaagagaauacaagaagaaagacgcccccagacucccacgcauacuccccgcaggccgagacgucagcgcauucucaaaacucauguacgcacucacgauguuccucgacggcaaagaaauaaacgaccuccuaacaacccuaaucaacaaauucgacaacauacaaucguuccucaaagucaugccccucauuggcguaaacgcgaaguucguagaagaauacgcguucuucaaagacucagccaaaauagccgacgaacuacgccuuaucaagagcuucgccaggaugggagagccgauagcagacgcacggagagccauguacaucgacgcaaucagaauacuuggcaccaaccuaucuuacgacgagcugaaagcccuggccgacaccuucucacuagaugagaacggaaauaagcucaagaaaggcaaacacgggaugagaaacuucaucaucaauaacgucaucuccaacaaacgcuuccacuaccuaauucgcuauggagacccugcucaccuacacgaaauagccaagaacgaggcaguaguaaaguucgugcuaggccgaauagccgacauccagaaaaagcaaggccaaaauggcaaaaaccaaaucgaccgauacuacgaaacguguaucggaaaggacaaggggaaaucggucagcgaaaaggucgacgccuuaaccaagaucaucacagggaugaacuacgaccaauucgauaagaaacgaucagucaucgaagacacaggccgcgaaaacgcugaacgcgaaaaauucaagaaaauaaucagccucuaccucaccguaauauaucauauccucaaaaacaucgugaacauaaacgcccgcuaugucauagguuuccacugcguugagcgagacgcacaacucuacaaagagaaaggauacgacaucaaccucaagaaacuugaagagaaaggguucucaucuguaaccaaacuaugcgccgguaucgacgaaacugcacccgacaaaagaaaagacgucgaaaaggagauggcagaacgcgccaaagagucaauagauucacuagaaagcgcgaacccgaaacucuacgcaaacuauaucaaauacagcgaugagaaaaaggcagaagaguucacccgccaaaucaaccgagaaaaagccaagaccgcacuuaacgccuaccuacgcaauaccaaauggaacgucauaauccgagaagaccuccucagaauagauaacaaaacgugcacccucuuccgcaacaaagcaguccaccucgaaguagcacgauacgugcacgcauacauaaaugacaucgcagaagucaacucauacuuccaacucuaccacuacauuaugcaaaggaucauaaugaacgaacgauacgagaaaucaagcggaaaaguaucagaauauuucgacgcggugaacgacgaaaagaaauacaacgacagacugcugaaacuccugugcguaccauucggguacugcaucccacgcuuuaaaaaccucagcauagaagcccuguuugaccgcaacgaagccgccaaauucgauaaagagaaaaagaaagucagcggaaacucggguucugggcccaaaaagaaacggaaggucgccgcagccuacccauacgacguccccgacuacgccuga

SEQ ID NO: 14454 - RNA, 3003 nt, Artificial Sequence
  Cas13d variant__Ruminococcus flavefaciens XPD3002__NLS-dRfxCas13d-NLS-HA (dCasRx)
augagccccaagaagaaaagaaaagucgaagccucaaucgaaaagaagaaauccuucgccaaaggcaugggggucaaauccacuuuaguauccggcucaaaaguguauaugaccaccuucgcggaaggcuccgacgccagacucgaaaagaucguagaaggagacuccauccguuccguuaacgaaggagaggcuuucagcgccgagauggcggacaaaaacgcuggcuacaaaaucggcaacgccaaauucagccaccccaaaggguacgcggucguggccaacaacccccucuauaccggcccgguccaacaggacaugcucggacugaaagaaacccuagagaaaagguacuucggagaaagcgccgaugggaacgacaacaucugcauacaggucauccacaacauccucgacauagagaaaauacuggcggaauacaucaccaacgcugccuacgccgucaacaacauaagcggacucgacaaagauaucauaggguucggcaaguucucuaccgucuauaccuacgacgaguucaaggaucccgaacaccauagggccgccuucaacaacaaugacaaacucaucaacgccaucaaggcacaguacgacgaguucgacaacuuccuugacaacccaagacucggcuacuucggccaagccuucuucagcaaagaaggcagaaauuacauaauaaacuacggaaacgaaugcuacgacauccuagccuuacucaguggccucgcgcacugggucguagcgaacaacgaagaagaaagcaggaucuccaggacuuggcucuacaaccucgacaagaauuuagacaacgaauauauuucgacccuaaacuaccuauacgaccgcaucaccaacgaauuaacaaacuccuucuccaaaaacucagcagccaaugugaacuacaucgcugagaccuuaggaauaaaccccgcagaguuugcugaacaauacuuccgauucagcauaaugaaagaacagaaaaaccuaggguucaacauuacaaagcuccgugaagugaugcuagaccggaaagacaugucugaaaucagaaagaaccacaaaguauucgacagcauacgcaccaaagucuacacuaugauggacuucguaauauacagguacuacaucgaagaagacgcaaaagucgcagcagcaaacaaaucgcuccccgacaaugaaaagagccuaagcgaaaaagacaucuucguaauuaaccuccgcggcagcuucaacgacgaccaaaaagacgcccuauauuacgacgaggccaaccgcaucuggcgcaagcucgaaaacauaaugcacaacaucaaagaguuccguggaaauaaaacgcgagaguacaaaaagaaggacgcaccccgccuaccaagaauccucccagccggcagggacgucucugcauucucaaaacucauguaugcccuaaccauguuccuagacggaaaagaaaucaaugaccuauuaacaacccuaaucaacaaauucgacaacauacagagcuuccuuaaagucaugccccucaucggaguaaacgcaaaguuuguagaagaauacgcauucuuuaaggacagcgccaagauugccgacgaacuaagacucauaaagagcuuugcaaggaugggcgaacccauugcugacgcacgacgcgccauguacaucgaugcuauacgcauucugggcacaaaccucucguacgacgaacucaaagcccuagccgacacguucagccuggacgaaaacggcaauaaacucaagaaaggcaagcaugggaugcggaacuucauaauaaacaacgucaucucuaacaagcgauuccacuaccuaauccgcuacggcgacccggcccaccuccaugaaaucgccaaaaacgaagcagucgucaaauucguccuaggccgcaucgccgacauacaaaagaaacaaggccaaaacgggaaaaaucaaauagaccgcuacuacgaaacgugcauaggcaaagacaaaggaaaaagcgugagcgaaaaggucgacgcccuaacaaagauaaucacggggaugaacuacgaccaauucgacaagaaacgauccguaaucgaagacaccggccgagaaaacgcagaacgggagaaauucaagaaaauuaucucacuauaccucacagucauuuaccacauccucaaaaacaucgucaacauaaacgcccgguacgucauaggcuuccacugcguggagcgagacgcacagcuauacaaagaaaaaggcuacgacaucaaccucaaaaagcuggaagaaaagggcuucucgucaguaaccaaacucugcgccggcaucgacgaaacggccccagacaaacgaaaagacguggaaaaggagauggccgaacgagcgaaagagagcaucgacucacuagaaucagccaauccaaagcuguacgccaacuacauuaaauacucagacgagaagaaagcagaagaguucacgcggcaaauaaaccgcgaaaaggccaaaacagcgcucaacgccuaccuacgaaacaccaaauggaacgucauaauccgcgaagaccuccuccgaaucgacaacaaaaccugcacacucuucgccaacaaagccguggcacuagaaguagcgcgguacguacacgccuacauaaaugacauugcagaagucaauagcuacuuccaacuguaccacuacauaaugcaacgcaucaucaugaacgaacgauacgaaaagaguagcggcaaagucucagaauacuucgacgcaguuaacgacgaaaagaaauacaacgacagacugcuuaaacugcuaugcguaccuuucggguauugcauaccaagguucaaaaaccucuccaucgaggcuuuauuugacagaaacgaagccgcaaaauucgacaaagagaaaaagaaagucucaggcaauagugggagcgggccaaagaagaaacgaaaaguagcggccgcguacccuuacgacguccccgauuacgccuga

SEQ ID NO: 14455 - RNA, 3381 nt, Artificial Sequence
  Cas13d variant__Ruminococcus flavefaciens XPD3002__hnRNPa1-dCasRx-HA
augggaaggucaggcagcggcaacuucggcggcggacggggcggcggguucggcggaaacgacaacuucggccgcggcggaaacuucucgggcagagggggcuucggagggucccgcggcggaggcggcuacggcggcuccggcgacggcuacaacggcuucggcaacgacggguccaacuucggaggaggaggcuccuacaaugacuucggcaacuauaacaaccaauccagcaacuucggacccaugaaaggaggaaacuucggcggccgaagcuccggcccauauggagggggcgggcaguacuucgccaaaccaagaaaccaaggcggcuacggcggauccuccagcaguucaucauacggcucaggucgccgauucucaccgaaaaagaaacgcaaaguagaggccagcauagagaagaagaaaucauucgccaaaggaaugggcgugaaaagcacacucgucuccggcagcaaagucuauaugacaacguucgccgaaggcuccgacgcacgacucgagaaaauaguugaaggcgacagcauaagaagcgucaaugagggagaggcauucucugcagaaauggcggacaaaaacgcgggguacaaaauaggaaacgccaaauucagccacccgaaaggcuaugccgucguggccaacaauccacuguacacuggacccguccagcaagacaugcugggacucaaagagacccuagaaaaacgcuacuucggcgaauccgcagacggaaacgacaacauuuguauacagguaauacacaacauacucgacaucgagaaaauccuugcggaauacaucaccaacgcggccuaugcaguuaacaacaucagcggacucgacaaagacauaauaggcuuuggcaaguuuucaaccgucuauaccuaugacgaguucaaggaccccgaacaccaucgggccgcguucaacaacaacgacaaacuuaucaacgcaaucaaagcgcaauacgacgaauuugacaauuuccucgacaacccccgacuaggcuacuucggacaagcauucuucucuaaggaaggccgcaacuacauaaucaauuacgggaaugaaugcuacgacauacucgcccuccuaagugggcuggcccacuggguggucgcuaacaacgaagaagaaucccgcaucagucgcaccuggcuauacaacuuagauaaaaaccuagacaacgaauacaucagcacacuaaacuaccucuacgaccgcaucaccaacgaacucacaaacuccuucucaaagaacuccgccgccaaugugaacuacauagccgaaacccuaggaaucaacccagccgaguucgcugaacaguacuuccgauucagcauaaugaaggaacagaagaaccuaggcuucaauaucaccaaacuccgcgaagucaugcuagaucgcaaggacaugucagaaauccggaaaaaccacaaagucuucgacuccauccgcacgaaggucuacacaaugauggauuuuguaauauaccgguacuacaucgaagaagacgccaaaguagccgccgccaacaaaagucuucccgacaacgaaaagucccuaucagaaaaggauauauucguaaucaaccuccggggaaguuucaacgacgaccaaaaagacgcccuguacuacgacgaagccaaccgcaucuggagaaaacucgaaaauauaaugcacaacaucaaggaguuccgugggaacaagacccgggaauacaaaaagaaagaugcaccacgccucccccguauucugccagccggacgagaugucuccgcguucucaaaacuaauguaugcccucaccauguuucucgacggaaaagagauaaacgaucuacucaccacccuuauaaacaaauucgacaacauccaaucauuccuaaaggucaugccgcuaaucggcgucaacgccaaauucguagaggaguacgcauucuuuaaagacagcgccaaaaucgccgacgaauuaagacuaaucaaaucguucgccagaaugggagaaccaaucgccgacgcucgacgcgcgauguacauugacgcaauacgaauacugggaacuaaccucucauacgacgaacucaaagcucucgcugauacuuuuagccucgacgaaaacggcaacaagcuaaagaaaggaaagcauggaaugcgaaacuucauaauaaacaacgucaucagcaacaagcgcuuucacuaccugaucagauacggcgacccagcacacuuacaugagauagccaaaaacgaagccgucguaaaguucguuuuaggccgaaucgcagacauccagaagaaacaaggccaaaacgguaaaaaccaaaucgaccgcuauuacgaaacaugcauaggaaaagacaaaggcaagagcguaucagaaaaagucgacgcgcuaacaaaaauaaucaccgggaugaacuacgaccaguucgacaagaagcgauccguaauagaggacaccggacgagaaaacgccgaaagagaaaaauucaagaaaaucaucagccucuaccuaacagucaucuaccacauucugaaaaacaucguaaacaucaacgcccgauaugucauaggguuccacugcguagaacgcgacgcccaacucuacaaagagaagggcuacgacaucaaccucaagaaacuagaagagaaaggauucucauccguaacaaagcuaugcgccggcauagacgaaacggcccccgacaaacgaaaggacgucgaaaaagaaauggcagaacgggccaaggaauccaucgacagccuagaauccgcgaacccaaaacuauacgccaacuacaucaaauacucagacgagaagaaagccgaagaguucacucgccaaauaaaccgagaaaaagccaaaacagcgcucaacgcauaccuccgaaacacaaaauggaacguuaucaucagagaagaccuauuacgaauagacaacaaaacgugcacacucuucgcaaacaaagcaguugcccuagagguagcaagauacgugcacgcguacaucaacgacaucgccgaagucaacucguacuuucaacucuaccacuacauuaugcaacgcaucauaaugaacgaacgcuaugagaaaagcagcggcaaagucuccgaguacuuugacgccgucaaugaugaaaagaaguacaacgaccgccugcugaaacucuuaugcguaccuuucggauacugcauaccccgcuucaagaaccuaucuaucgaggcacuuuucgaccggaaugaagccgccaaauucgacaaggagaagaaaaaggucucgggaaacucaggauccgguccuaagaaaaagagaaaaguagcggcugcguacccauacgacguccccgacuacgcuuga

SEQ ID NO: 14456 - RNA, 2787 nt, Artificial Sequence
  Cas13d variant__Uncultured Ruminococcus sp. __UrCas13d-HA
auggccaaaaagaacaagaugaagccccgagaacuccgcgaagcacagaaaaaggcaagacagcucaaggccgccgagauaaacaacaacgcagccccagcaaucgccgccaugccggcggccgaaguaaucgcccccgccgccgaaaagaagaaauccagcguuaaagccgccggaaugaaaucaauccucguaucagaaaacaaaauguauaucaccaguuucggaaaaggaaacagugccguacuagaauacgagguggacaacaacgacuauaaccagacgcaacugucguccaaagacaacagcaacauacaacuaggaggcgucaacgagguaaacauaacguucagcucaaaacacggcuucgaaucgggcgucgaaaucaacacguccaacccuacacaccgguccggcgaaagcucaccgguccgcggagacaugcuuggauugaaaagcgaacucgagaaacgauucuucgggaaaacuuucgacgacaauauccacauacaacuaaucuacaacauacucgauauagaaaagauacuagccguguaugucacaaacaucgucuacgccuuaaacaacaugcuaggcgucaaaggcagcgagagccacgacgacuucaucggcuaccugucaaccaacaacaucuaugacguauuuauagacccggacaacucuucucuauccgacgacaaaaaggccaacguaaggaaaagccucuccaaauucaacgcacuccugaaaacgaagcggcucggauauuucggccucgaggagccaaaaacaaaggacaaccgaguaucccaggccuacaaaaagcgaguauaccacaugcucgccaucgucggacagauacgucaaugugucuuccacgacaaauccggcgccaaacgguuugaccuauacucuuuuaucaacaacaucgacccagaauaccgcgacacgcuagacuacuuagucgaggaacgccucaaaagcauaaacaaagacuucaucgaagacaacaaaguuaacauaucucugcuaaucgacaugaugaaagguuacgaagccgacgacaucauccgacucuacuacgacuucaucguccucaaaagccagaaaaaccuuggauucuccaucaagaaacucagggagaaaaugcuagacgaauauggcuuccgauucaaagacaaacaauacgacucgguacgcagcaaaauguacaaacuuauggacuuccuacuauucugcaacuacuacagaaacgacauagccgcuggagaaucccuugugcgaaaacugcgcuucucaaugaccgacgacgaaaaagaaggcaucuacgccgacgaagccgcgaaacucuggggaaaauuucgaaacgacuucgaaaacauagcggaccacaugaacggagacgucauaaaagaacugggaaaggcggacauggacuucgacgagaaaauccuggacucagagaaaaagaacgccucggaccuccuguacuucagcaaaaugaucuacaugcuaacauauuuccucgacggcaaggaaaucaaugaccuccucacgacacugaucucgaaguucgacaacauaaaagaguuccuaaaaauaaugaaaucaucagccguagacguggaaugcgaacucaccgcaggcuacaaacucuucaacgauagccaacgcaucaccaaugaacuuuucauagucaaaaacauugccagcaugagaaaacccgcagcaagcgcgaaacugacaauguuccgggacgcccuaaccauccuaggaauagacgauaaaaucacggaugacagaaucuccgggauccuaaaauuaaaagaaaaagggaaggggauccacggccuacgaaacuucaucacgaacaauguaauagaaagcucaagauucguauacuuaauuaaauacgcgaaugcccagaaaauacgggaagucgccaaaaacgaaaaagugguaauguucgugcugggcggcauccccgacacgcaaaucgagagguacuacaaauccugcgucgaguuccccgacaugaacaguucccucggcgugaagcgaagcgagcuugcucgcaugaucaaaaacaucucauucgaugacuucaaaaaugucaaacaacaagccaagggccgcgagaaugucgccaaagagcgggcaaaggcaguaaucggucucuaccucacagucauguaccuacucgucaaaaaccuagucaacgucaacgcccgguacgucaucgccauacacugccuagaacgagacuuugggcucuacaaggaaauaauccccgaacuagcauccaaaaaccucaagaacgacuacagaauacucucacaaacccucugcgaacugugugauaaaagcccaaaucuauuccugaaaaagaacgaacgacuacgcaaaugcgucgaaguggacaucaacaacgcagacagcagcaugaccagaaaauacagaaacugcauagcacaucuaaccgucgugcgagaacuuaaggaguacauaggggacaucugcacggucgacaguuacuucucgaucuaucacuacguaaugcaacgaugcaucacaaaacgagagaacgacaccaagcaagaagagaaaauaaaauacgaagacgaccuccucaaaaaccacggguacacaaaagacuucguaaaagcccucaacagccccuuuggguauaauaucccgcgauucaaaaaccucucaaucgaacaauuauucgaccgcaaugaguaccucacugaaaaauaccccuacgacgucccggacuacgccuga

SEQ ID NO: 14457 - RNA, 2787 nt, Artificial Sequence
  Cas13d variant__Uncultured Ruminococcus sp. __dUrCas13d-HA
auggcaaagaaaaacaaaaugaaaccgcgcgagcuucgggaagcccagaagaaagcccgucagcucaaagcagccgaaaucaacaauaacgccgccccggcaaucgccgcaaugccggcagcagaggucaucgcaccagccgccgagaaaaagaaaagcuccguaaaagcggccggcaugaaaagcauccucguguccgaaaacaaaauguauaucaccaguuucggcaaaggaaacagcgcgguccucgaauacgaaguugacaauaacgacuacaaccaaacccaacuauccuccaaagacaacuccaauauacaacucggcggaguaaacgaagugaacauaacuuuuuccuccaaacacggauucgaaagcggcgucgaaaucaacacaucaaacccgacacaccgcucaggggaauccuccccuguacguggcgacaugcucggccuuaaaagcgaacuggagaaaagauucuucgguaaaaccuucgacgacaacauccauauacaacucaucuacaacauccuagacauagaaaagauccuagccguguacgugacaaacauagucuacgcccucaacaacaugcucggggucaaaggcagcgaaucccacgacgacuucaucggcuaccucuccacuaacaacauauacgacgucuucauagacccugacaauucauccuugagcgacgacaaaaaggcuaacguccgcaaaucacuaagcaaauucaacgcccuccuaaagacgaaacgccuaggguacuucggccuggaagaacccaaaaccaaagacaaccgcgucucgcaagccuacaaaaagcgcgucuaccacaugcuggccaucgucggucaaaucgcccaaugcguauucgccgauaaaaguggggcgaaacguuucgaucucuacucguucauaaacaacauugaccccgaauaccgagacacucucgacuaccuaguggaagaacgccucaagucgauaaacaaagacuuuauagaagacaauaaagugaacaucucacuccuuauugacaugaugaaaggcuacgaagccgacgacaucauccgcuuauacuacgacuucaucguacuaaaaucccagaaaaaccuaggcuucagcauuaagaaacugcgagagaaaaugcuagacgaauacggauuccgauucaaagacaagcaauacgacaguguacgaucgaagauguacaagcucauggacuuccuccucuucugcaacuacuaccgcaacgacaucgccgcaggcgaaucgcuggucaggaaacuacgauucuccaugaccgaugacgaaaaagaagguaucuacgccgaugaagcagccaaacucugggggaaguuccgcaacgacuucgaaaauaucgcggaccacaugaacggagacgucaucaaagaacucggaaaagcagacauggacuucgacgagaaaauccuagacuccgaaaagaaaaacgccuccgaccuccucuacuucuccaagaugaucuacaugcucacguauuuccucgacggaaaagaaaucaaugaccuauuaacgacacucauaucaaaauucgauaacaucaaagaguuccucaaaauuaugaaaucaucugccgucgaugucgaaugugaacugacggccggcuacaagcuauuuaacgacucacaacgcaucacaaacgaacuauucaucgucaagaacauagccagcaugcgcaaaccagccgccuccgcaaaacucacaauguuccgcgacgcccucacuaucuuaggaauugacgacaaaaucaccgacgaccgcaucucagguauucuaaaacucaaagaaaagggaaaaggcauccacggccugcgcaacuucaucacaaacaacgucaucgaauccagccgguuuguauaucucaucaaguaugccaacgcacagaaaauccgcgaagucgcaaagaacgaaaaagucgucauguucguccucggcggcaucccagauacucaaaucgagcgauauuacaaauccugcguagaguuccccgauaugaacagcucgcuaggcguuaagcggucagaacucgcaagaaugauuaagaacauauccuuugacgacuucaaaaacgucaaacaacaagcgaagggccgcgaaaacguggcaaaagaacgggcgaaagccgugaucggccucuaccuaaccgucauguaccuacucgucaaaaaccugguuaacgucaacgcacgcuacgucaucgccauacauugccuggaacgugauuucggcuuguacaaagaaauaauaccagaacuugccuccaaaaaccugaaaaacgacuaccgaauccucucccagacauuaugcgaacucugugauaaaagcccaaaccuauuucuaaagaaaaacgaaagacugcgaaaaugcguggagguagacaucaacaacgcugacagcucuaugacacgcaaauacgccaacugcaucgcagcacuaaccguagucagggaacuaaaggaauacaucggagacaucugcaccguagacuccuauuucagcauauaccauuacgucaugcaacgcugcaucaccaaacgagaaaacgacaccaaacaagaagaaaagaucaaguacgaagacgaccugcuuaaaaaccacggauacacaaaggacuuugucaaggcgcucaacucccccuucggauacaacauaccacgcuucaaaaaucuaucgauagaacaacuauucgaccgcaaugaguaccucacggagaaauacccauacgacguccccgacuacgccuga

SEQ ID NO: 14458 - RNA, 2859 nt, Artificial Sequence
  Cas13d variant__Uncultured Ruminococcus sp. __NLS-UrCas13d-NLS-HA
augagccccaaaaagaaacgaaaaguagaagcgagcgccaagaaaaacaaaaugaaaccacgagaacucagggaagcgcaaaagaaagcccgccagcucaaagccgccgaaaucaacaacaacgcagcacccgccaucgccgcuaugcccgcggccgaaguaaucgcacccgcagcggaaaagaagaaauccagcgucaaagcugccggaaugaaaucgaucuugguguccgaaaacaaaauguacaucacaucauucggaaaaggcaacuccgccgugcucgaguacgaaguggauaacaacgacuacaaccaaacccaacuaagcagcaaagacaacuccaacauacaauuagggggcgucaacgaagugaauauaaccuucucuucaaaacacggcuucgagucaggagucgaaaucaacaccagcaacccgacacaccgcucaggcgaauccagcccgguucgcggagacaugcugggccuuaaguccgaacuugaaaagcgguucuucgguaagaccuucgacgauaacauccacauccaacugaucuacaacauccuagacauagagaagauucuggcagucuacgucacgaacaucgucuacgcgcucaacaauaugcugggagucaaagguagcgagagucacgacgacuucaucggcuaccucagcaccaacaacauauacgacguauucaucgaccccgacaacagcagccuuagcgacgacaagaaagcaaacguacgaaagagccucagcaaauuuaacgccuuacucaaaacgaaaaggcuaggcuacuucggucuggaagaaccuaaaaccaaggacaaccgagucagccaggccuacaagaaaaggguauaccacaugcuagccauagucggacagauucgacaguguguauuccacgacaaaagcggagcaaaacgauucgaucucuauuccuucaucaacaacaucgaccccgaauaccgcgacacacuggacuaccucguagaggaacgccucaaaucuauaaacaaagacuucauagaagacaacaaagucaacaucucccuccuaauagacaugaugaaaggcuacgaagccgaugacauaaucaggcucuacuacgacuucauaguccuaaagucacagaaaaaccucggauucucaaucaagaaacuacgcgagaaaaugcuggacgaauacggauucagauucaaagacaagcaauacgauagcguacgguccaaaauguacaaacugauggacuucuuacucuucugcaacuacuaucgcaacgauaucgccgcaggggaaucacucguccgcaaacuccgcuucagcaugacagacgacgaaaaagaaggcaucuacgccgacgaagccgcaaaacucugggggaaauuccgcaacgacuuugaaaacaucgcagaccacaugaacggcgacgucauaaaagaacuaggaaaagcagacauggacuucgacgagaaaauacuagacuccgaaaagaaaaaugccuccgaccuucucuacuucucgaaaaugaucuacaugcucacuuauuuucucgacggaaaggaaauaaacgaccuacugacgacccuaaucucaaaguucgacaacauaaaagaguucuuaaaaauaaugaaaagcucggccgucgacgucgaaugugaacucacagcgggcuacaaacuguucaaugacagccaacggauaacaaaugaacuauucaucgucaaaaacauagccuccaugcgcaaacccgcagcaagcgccaagcuaacgauguuccgagacgcacucacuauccucgggaucgacgacaaaauaaccgacgaccgaauaucaggcauccugaaacuaaaagaaaagggcaaaggaauacacggccuccgaaacuucauaacuaacaacgugaucgaaucgucaagauuugucuaucuaauaaaauacgccaacgcccagaaaauacgugaaguggcgaaaaacgaaaaaguggugauguucgugcuaggagggauccccgacacgcaaauugaacgcuacuacaaaagcugcguagaguucccagauaugaacucaucccuuggcgucaagagauccgaacucgcaagaaugaucaaaaacaucucuuucgaugacuucaaaaacguaaagcaacaagccaaaggacgggaaaacgucgccaaagaacgggcaaaggcugugaucgggcucuaccuaaccgucauguaccucuuggucaagaaccuagucaacguaaacgccagguacguaauugccauccacugccucgaaagagauuucggucucuacaaagagauaauccccgagcuagcauccaaaaaccucaagaacgacuacagaauacugagccaaacccugugcgaacucugcgauaaaucaccaaaccucuuccucaaaaagaacgaacgccuccgcaagugcguugaagucgacauaaacaacgccgacuccucaaugacccgaaaauaccgaaacugcaucgcgcaccuuacagucguccgggaacuaaaagaauacauaggcgacaucugcacagucgacagcuacuucuccaucuaccacuacgugaugcaacgcugcauaacaaaacgggagaacgacacgaaacaggaagagaaaauaaaauaugaagacgaccuccucaaaaaucacggauacacaaaggacuuugucaaggcccuuaacucgcccuucggauacaauauaccacgguucaagaaccuguccaucgaacaacuauucgauagaaacgaauaucuaaccgaaaaaggaagcggcccaaagaagaaacggaaggucgcagccgccuauccguacgacgucccggacuacgccuga

SEQ ID NO: 14459 - RNA, 2859 nt, Artificial Sequence
  Cas13d variant__Uncultured Ruminococcus sp. __NLS-dUrCas13d-NLS-HA
augucccccaaaaagaaacgcaaagucgaagcuagcgcaaagaaaaacaaaaugaaaccacgagaacuucgcgaagcacaaaagaaagcgcgccagcuaaaagccgcggagaucaacaauaaugcagcccccgccauagccgccaugcccgccgccgaagucaucgccccggccgcugaaaagaagaaaaguuccguaaaagcggcagggaugaaauccauacucguaucagagaacaaaauguauauaaccucauucggcaaaggaaacucagccguccuggaauacgaaguggacaacaacgacuacaaccaaacccaacuaagcagcaaagacaacuccaacauccagcucggcggggucaaugaaguuaacaucaccuucagcuccaaacauggcuucgaaagcggagucgaaaucaacacaagcaaccccacccaccgcaguggagaguccucuccaguacggggcgacaugcuaggccuaaaaagcgagcucgaaaaacgauucuucgggaaaaccuucgaugacaacauccacauccaacucauauacaacauccucgacauagaaaagauccuggccguauacgucacgaacaucguguacgcccugaacaacaugcugggagucaaaggcucagaaagccacgaugacuucauaggguaccucagcaccaacaacauauacgacgucuucaucgaccccgauaauucaagccucucagacgacaagaaagcaaauguccgcaaaucucuaagcaaauuuaacgcacuccucaaaacaaaacgauuaggguacuucggucuugaagaaccaaaaaccaaagacaaccggguaucgcaagcauacaaaaagcgagucuaccacaugcucgccauugucggacagaucgcgcaaugcguauucgcggacaagucuggagcaaaacgguucgaccuauacucguucauaaacaacaucgaccccgaguauagagacacccucgacuaccugguagaggaacgacuaaagagcaucaacaaggacuucauagaagacaacaaaguaaacaucagccuacucaucgacaugaugaagggcuacgaggccgacgacauaauccgccuguacuacgauuucauagugcuaaagagccagaaaaaccugggcuucucaaucaagaaacucagagagaaaauguuagacgaguacggcuuccgcuucaaagacaaacaauacgacagcgugcggaguaaaauguacaaacuuauggacuuucuucucuucugcaacuacuaccguaacgacauagcagcaggagaaagccuugugagaaaacuacgauuuuccaugaccgacgacgaaaaggaaggcaucuacgccgacgaagccgcgaagcuauggggcaaauucaggaacgacuucgaaaacaucgccgaccacaugaacggcgacgucauaaaagaacucggaaaagcugacauggacuucgacgaaaagauccucgacuccgagaaaaagaacgcuuccgaccuccucuacuucuccaaaaugaucuacaugcuaacauauuuccuggauggcaaagaaaucaaugaccuccucaccacucucaucucgaaguucgauaacaucaaggaguuccucaaaaucaugaaaucaagcgcaguagacgucgaaugcgaacucacggcaggcuacaaacucuuuaaugacagucaacgcaucaccaacgaacuauucaucgucaaaaauauagcgaguaugcgcaaaccagcggccagcgcgaaacugacaauguucagggacgcccugaccauccucggaaucgacgacaaaaucaccgacgaccgcaucagcggcauucucaaguuaaaggaaaaaggaaagggaauccacggccuccgaaacuucauaaccaacaacgucauagaaagcucacgguucguguaccucaucaaguacgccaacgcccagaaaauacgcgaagucgcgaaaaacgaaaagguaguuauguuuguccuaggaggaauacccgacacucaaaucgaaagauauuacaagagcugcgucgaguucccagacaugaacucaucgcuaggcguaaaacgcagcgaacucgcacgaaugaucaaaaacauuaguuucgacgacuucaaaaacguaaaacaacaagcaaagggacgggaaaacguagcuaaggaacgcgcaaaggcagugauaggacucuaccucacaguuauguaccucuuagucaaaaaccuagucaacguaaacgcccgguacgugaucgccauccacugccuagagagagauuucggccucuacaaggaaaucauccccgaacuggcgagcaagaaccucaaaaacgacuaccgcauacugucacaaacgcuaugcgaacugugcgacaaaucacccaaccuauuccugaaaaagaacgaacgccuacgaaagugcgucgaggucgacauaaacaaugcagacuccucaaugacgcgaaaauacgccaacugcaucgccgcccucacagucgugagagaacucaaggaauacauaggggacaucugcacaguagacuccuacuucaguauauaccauuaugucaugcaaaggugcaucaccaagcgcgagaaugacacaaaacaagaagagaaaauuaaauacgaagaugaucuccucaaaaaccacggauacaccaaagacuucgucaaagcccucaacucgccauucggcuacaacauaccaagauucaaaaaccucucgaucgaacaauuauucgaccgaaacgaauaccucacugaaaaaggcucaggcccaaagaagaaaagaaagguggccgcggcauacccguacgauguccccgacuacgcauga

SEQ ID NO: 14460 - RNA, 4275 nt, Artificial Sequence
  Cas13d variant__Leptotrichia wadei __NLS-LwCas13a-msfGFP
augaaaagaccugccgccacaaagaaggcaggacaggcuaaaaagaagaaaggaagcaugaaaguaacaaaagucgauggcaucucgcacaagaaauacauagaggagggcaaacucguuaaaucgacuucggaagagaaccgcaccagcgagcgacucuccgagcuccucagcauacgucuggacaucuauaucaaaaacccagauaacgccagcgaagaagaaaaccggauccggagagaaaaccuaaagaaauucuuuagcaacaaaguuuuacaccucaaggacucaguccucuaccugaaaaaccgcaaggagaaaaaugcaguccaagacaagaauuacuccgaagaagacaucucugaauacgaucugaagaacaagaacuccuuuucaguccucaagaaaauacucuuaaacgaagacgugaacagcgaggaacuggaaaucuuccgcaaagacguagaagccaagcuaaacaagaucaacucauuaaaguauucguucgaagagaauaaggccaauuaccaaaagaucaacgagaacaacgucgagaaagucggaggcaaaucuaaaagaaacauaauauacgacuacuaccgcgaaagcgcgaagcgcaacgacuauauaaacaaugugcaggaggcuuucgacaaacucuacaagaaagaagacauugaaaaacucuuuuuccugauagaaaacucuaagaaacaugaaaaauacaagauccgcgaguacuaccacaaaaucaucgggcgaaagaaugacaaggaaaacuucgccaagaucaucuacgaagagauccaaaacgucaauaauaucaaagaguuaauagagaagauccccgacauguccgaacucaaaaagucucagguauucuacaaguauuaccucgauaaagaggaacucaacgacaaaaacauuaaguacgcguuuugucacuucguagagaucgaaaugucacaacuucuaaagaacuacguauacaaacgccucuccaacaucuccaacgacaaaaucaaacguaucuuugaauaccagaaucuaaagaaacucaucgaaaacaaacuccucaauaagcucgacaccuacguacggaacugcggaaaguacaacuacuaccuccaggucggagagauugcaaccucagacuucaucgcucgcaaccgccaaaacgaagccuuccugcgcaacaucaucggcgucuccucggucgccuacuuuagccuccggaacauuuuggaaacagaaaacgagaacggaauaaccggacgcaugaggggcaagacgguuaagaacaacaagggggaagagaaguacgucuccggcgaaguggacaaaauauacaacgagaacaaacaaaacgaggucaaagagaaccucaaaauguuuuacagcuacgacuuuaacauggacaacaaaaacgaaaucgaggacuucuucgccaacauagacgaagccauaagcagcauacgacacggaauaguacacuucaaccuggagcuagaaggaaaagacauauucgcauucaaaaacaucgcgccgucugagaucagcaaaaagauguuccagaacgaaauaaacgagaaaaagcucaaacugaagauauucaagcaacucaauucagcuaacgucuucaacuacuacgaaaaagaugugaucaucaaguaccugaaaaacaccaaauucaacuucguaaauaaaaacauaccauucguccccucguucaccaagcuauacaacaaaauagaagaccuacgcaacacccucaaguucuucuggucgguaccaaaggacaaagaagagaaggacgcccaaaucuaccuauuaaagaacauauacuacggagaauuucuaaauaaauucgugaaaaacagcaaggucuucuucaaaauaacgaacgagguaauuaaaauaaacaaacagcgaaaucagaaaacaggacacuacaaguaccaaaaauucgaaaacauagaaaagacaguuccagucgaauaccuagcgaucauccaaucucgcgagaugaucaacaaccaagacaaggaggagaaaaacacguacaucgacuuuauacagcaaauauuccucaagggguucaucgacuaucugaacaaaaacaaccucaaauacaucgaaucgaacaacaacaaugacaacaacgacaucuucucaaaaaucaagauaaagaaggauaacaaagaaaaguacgacaagauacugaagaauuacgagaaacacaaccggaacaaagaaaucccccaugaaaucaacgaguucgucagggaaaucaagcucggaaagauccuaaaauacacagaaaaccugaacauguucuaucucauccugaaacuucucaaccacaaggaacucaccaaccuaaaaggcucucuagaaaaguaccaauccgccaacaaggaggagacauucagcgacgaguuagaacuaauuaaucucuugaaccucgacaacaaucgcguaacggaggauuucgaacucgaggcuaacgaaaucggaaaauuccucgacuucaacgaaaacaagaucaaggaucgcaaggaauugaagaaauuugacaccaacaaaauuuacuucgacggagaaaacaucauaaaacacagagcauucuacaacaucaagaaauauggaaugcucaaccuccucgagaaaauagcagacaaagccaaauauaaaauaucacuaaaagaacucaaagaguacaguaacaaaaagaacgagauagagaaaaacuacaccaugcaacaaaaucugcacaggaaauacgcccgacccaagaaagaugagaaauucaaugacgaggacuacaaggaguacgaaaaagccaucggaaacauacaaaaguacacgcaccucaaaaacaaggucgaguucaaugaauuaaaccuccuucaaggucuccuacuaaaaauccuacaccgucugguagguuacaccagcauaugggaaagagaucugcgauuccgucucaaaggcgaguuccccgaaaaucauuacauagaggaaaucuucaacuucgauaacagcaaaaacgucaaauacaaaagcgggcaaauaguagagaaguacaucaacuucuacaaggaacuguacaaggacaacgucgagaaaaggucaauauauucggauaaaaaggucaagaagcucaagcaagagaaaaaggaccuauacauccguaacuacauagcgcacuuuaauuacaucccacaugccgaaaucagccugcucgaaguccuagaaaaccuacguaaacuccuguccuacgaccgaaaacuaaagaacgcaaucaugaaauccauaguagacauucugaaagaauacggguucgucgccacauucaagauaggugcggacaagaagaucgaaauacaaacccuggaaagugagaaaauaguacaccucaagaaccucaagaaaaagaaacuuaugacggaccggaacucagaggaacucugcgaacucgucaaagucauguucgaguacaaagcccuagaagguggcggcgguagcggaggcggagggucaggagggggagggagcgucuccaagggcgaggaacucuucacaggcgucgugccgauccuggucgaacucgacggagacguaaauggacacaaauucagcguucgaggcgaaggagaaggggacgccacgaacggaaaacucacacuaaaguucaucugcaccaccgguaaacuccccgucccguggcccacauuaguuaccacccucacauauggagugcagugcuucagccgauaccccgaccacaugaagcagcacgacuuuuucaaaagcgccaugcccgaaggguacguccaggagcguacgaucagcuucaaggaugacggcaccuauaaaacacgagccgaggucaaauuugaaggagacacgcucgucaaccggauagaacucaaaggaaucgacuucaaagaggacgggaauauccugggccauaaauuagaguauaacuucaauucccacaacguauacauaaccgccgacaaacagaagaacgguauaaaagccaauuucaaaauccggcacaacgucgaggacggaagcguccaacuggcggaccauuaccaacagaacacaccaauaggcgacggaccggugcugcugccugacaaccacuaucuguccacccaaucuaaacucuccaaagacccaaacgaaaaacgugaccauaugguccuauuagaguucgugacggcggcggggaucaccuuagguauggacgaacucuacaaauga

SEQ ID NO: 14461 - RNA, 4275 nt, Artificial Sequence
  Cas13d variant__Leptotrichia wadei __NLS-dLwCas13a-msfGFP
augaaacgccccgcagccacgaagaaggccggacaagccaaaaagaagaaaggcagcaugaaggucaccaaaguagacgggaucucacacaagaaauacaucgaggaagggaagcuaguaaaaagcaccagcgaagaaaaccgaacgagcgagcgccugucugaacuccuuucgauacgucuagacauauacauuaaaaauccagacaaugcuagugaagaagagaaccgcauucgucgcgaaaaucucaaaaaguucuucucaaacaaggugcuacaccucaaggacagcguccuguaccugaaaaaccgcaaagagaaaaacgccguccaggacaagaacuacucugaagaagacaucuccgaguaugaccucaaaaacaaaaauucauucuccguacucaagaaaauccuguugaacgaagacguaaacucugaggagcuggagauuuuccgcaaagacguagaagccaaacugaacaagauaaauucucuuaaauacuccuucgaagagaacaaagcaaacuaucagaagaucaacgagaacaacguagaaaaggugggcggaaaaucaaaaaggaauaucaucuacgacuacuacagagaaagcgcgaagaggaacgacuacaucaauaacgugcaagaggccuucgacaagcuguauaagaaagaagacauagagaaacucuucuuucuaauagaaaauuccaagaagcacgaaaaguacaagauccgcgaauacuaccacaaaauaauuggccgcaagaacgacaaagagaacuucgcaaagaucaucuacgaggagauucaaaacguuaacaacauaaaagaacucaucgaaaagauuccugacauguccgagcucaaaaagagccagguauucuauaaguacuauuuagauaaagaggaacugaacgacaaaaacaucaaguacgccuucugccauuuugucgaaauagagaugagccaacugcugaaaaacuauguauacaagcggcuaagcaacaucaguaacgauaagaucaaaaggaucuucgaauaccaaaaccuuaagaaacuaaucgagaacaaacugcugaacaaacuagacacguacguccgaaacuguggcaaguacaacuacuaccuccaggucggcgaaaucgccacaagcgacuucauagcccgcaaccgccagaacgaagcauuccugcggaacaucauaggagucuccuccgucgcauacuuuaguuugcgcaacauccucgaaacagagaacgaaaacggcauuaccggucggaugcgaggcaagaccgucaaaaacaacaaaggcgaagaaaaguacguaaguggagaaguugacaaaauauacaacgagaacaaacagaaugaggucaaggagaaccuaaaaauguucuauuccuacgacuuuaacauggacaacaagaaugaaauugaggacuucuucgccaauaucgacgaggcuauaagcucaaucgcacacggcauaguacacuucaaccuggaacuagaaggaaaggacaucuucgccuucaagaacauagcgcccagcgaaaucuccaagaagauguuccaaaaugaaaucaacgaaaagaaacuaaaacugaaaauauucaaacaauuaaacucagccaaugucuucaacuacuacgaaaaagacgucaucaucaaauaucugaaaaacacaaaauucaauuucgucaauaagaacauacccuucguuccgagcuucacuaaacuauacaacaaaaucgaagaccuaagaaacacacucaaguucuucuggaguguaccaaaagacaaagaagagaaggacgcccagaucuacuugcuaaagaacauauacuacggagaguuccucaacaaauucgucaaaaacucgaagguauuuuucaagaucacaaaugaaguaauaaaaaucaacaagcagcggaaccagaagacgggacacuacaaguaccaaaaauucgaaaacaucgagaaaacgguacccguggaauaccucgcuauuauccaauccagggaaaugauuaacaaccaggacaaagaagagaagaacacauauauagacuucauccagcaaaucuuccuuaagggguucauagacuauuugaacaaaaacaaccugaaguacaucgaaagcaacaacaauaacgacaacaaugauaucuucucaaaaaucaagaucaaaaaggacaacaaggagaaauacgacaaaauacugaagaacuacgagaagcacaaccgcaauaaagaaauuccgcacgaaauaaacgaguucguacgugaaaucaaacuggguaaaauccuaaaauacaccgagaaccuuaauauguucuaccuaauccuuaagcuccucaaccauaaggaauuaaccaauuuaaaaggguccuuagaaaaauaccaguccgccaacaaagaagagacauucagcgacgagcucgaacuaauaaaccuccucaaucuagauaacaaccgcguaaccgaagauuucgaacucgaggcaaacgaaauuggcaaauuccuagauuucaacgagaacaagauuaaggaccgcaaagagcugaagaaauucgauacaaacaaaauauacuucgacggggaaaacaucauuaagcaccgcgcauucuacaacaucaaaaaguacggcaugcuaaaccuguuagagaagauagcagacaaagcaaaauacaaaaucagccugaaagaacucaaagaauacagcaacaagaaaaacgaaauugagaaaaacuacaccaugcagcagaacuugcaccguaaauacgcacgccccaaaaaggacgagaaauucaacgaugaggacuacaaagaguacgagaaggccauuggcaacauacagaaauacacccaucucaaaaacaaagucgaguucaacgaacuaaaccuacuacaggggcugcuacucaaaauccugcaccgccucgucggcuauaccagcaucugggaacgggaccuccgguuccgucuaaagggcgaauuuccagaaaaucacuacaucgaagagaucuucaacuuugauaacuccaaaaacguaaaguacaaaagcggacagaucguagaaaaauacaucaacuucuacaaagaacuauacaaggacaacguagaaaaacggagcauuuacucggauaagaagguaaagaaacuuaagcaggagaagaaagaccucuacaucgccaacuacaucgcccacuuuaacuacaucccccaugcagaaaucagucugcucgaggugcuggaaaaccugcgcaaacuacugaguuacgaccgaaaacucaaaaacgcuauuaugaaaaguauagucgacauacucaaagaauacggauucguugccacauucaaaaucggcgcggacaagaaaaucgagauccagaccuuagaaagugagaaaauaguacaccucaaaaauuuaaagaaaaagaagcuaaugaccgaccgaaacucggaggaacugugcgagcugguaaaagucauguucgaauacaaggcccuggaaggcggcggaggaagcggcggcggcggauccggaggcggaggcuccguguccaaaggggaggaacuauucaccggcguuguacccauccucguagagcuagacggggacgucaauggccauaaguucucaguacgcggcgaaggagaaggcgacgcaacaaacggcaaacucacacuaaaguucauuugcacgacggguaaacugccgguaccauggcccacccuagucacaacacuaacguacggcguccaaugcuucucacgcuacccagaccacaugaaacaacaugacuucuucaaguccgccaugccagagggcuacguccaagaacggacgauuagcuucaaagacgacggaacguacaagacgagagcggaaguaaaauucgaaggcgauacacuggugaaucgcaucgagcugaaagguaucgacuucaaagaagacggaaacauccuagggcacaagcuagaguacaacuuuaacagccacaaugucuacaucacagccgacaaacaaaagaacggcauaaaagccaacuucaagauccggcacaacguagaagacggcuccguccagcucgcagaucacuaucagcaaaauacgcccauuggcgacgggcccguacuccuacccgacaaccacuaccucucaacccaauccaaacuuaguaaggaccccaaugagaaacgggaccacauggucuuacuggaguucguuaccgcggccgguauuacacucgggauggaugaacuauacaaguga

SEQ ID NO: 14462 - RNA, 2868 nt, Artificial Sequence; identical to SEQ ID NO: 14322
  Cas13d variant__Anaerobic digester metagenome 15706__AdmCas13d-HA

SEQ ID NO: 14463 - RNA, 2868 nt, Artificial Sequence; identical to SEQ ID NO: 14323
  Cas13d variant__Anaerobic digester metagenome 15706__dAdmCas13d-HA

SEQ ID NO: 14464 - RNA, 2940 nt, Artificial Sequence; identical to SEQ ID NO: 14324
  Cas13d variant__Anaerobic digester metagenome 15706__NLS-AdmCas13d-NLS-HA

SEQ ID NO: 14465 - RNA, 2940 nt, Artificial Sequence; identical to SEQ ID NO: 14325
  Cas13d variant__Anaerobic digester metagenome 15706__NLS-dAdmCas13d-NLS-HA

SEQ ID NO: 14466 - RNA, 2892 nt, Artificial Sequence; identical to SEQ ID NO: 14326
  Cas13d variant__Eubacterium siraeum DSM15702__EsCas13d-HA

SEQ ID NO: 14467 - RNA, 2892 nt, Artificial Sequence; identical to SEQ ID NO: 14327
  Cas13d variant__Eubacterium siraeum DSM15702__dEsCas13d-HA

SEQ ID NO: 14468 - RNA, 2964 nt, Artificial Sequence
  Cas13d variant__Eubacterium siraeum DSM15702__NLS-EsCas13d-NLS-HA
augagccccaagaagaaacgcaagguggaggccuccggcaagaagauccacgcccgggaccugcgcgagcagcggaagaccgaccgcaccgagaaguucgcggaccagaacaaaaagcgggaggccgagcgcgccgucccgaagaaggacgccgccgugagcgugaaguccgucagcuccgugagcuccaagaaggacaacgugaccaagagcauggccaaggcggccggggucaaguccguguucgccgugggcaacacggucuacaugaccagcuucgggcggggcaacgaugcgguguuagagcagaagaucguggacaccucccacgagccccugaacaucgacgaccccgccuaccagcugaacgucgucacgaugaacggguacagcgugaccggccaccgcggcgagaccgucuccgccgugaccgacaacccccuccggcgcuuuaacgggcggaagaaggacgaaccggagcagagcgugcccacggacauguugugccugaagcccacccuagaaaagaaguucuucggcaaggaguucgacgacaacauccacauccagcugaucuacaacauccuggacaucgagaagaucuuggcagucuacuccaccaaugccaucuacgcgcugaacaacaugagcgccgacgagaacaucgagaacuccgacuucuucaugaaacgcaccacggacgagaccuucgacgacuucgagaagaagaaggagagcaccaacucccgggagaaggccgacuucgacgccuucgagaaguucaucgggaacuaccgccuggccuacuucgcggacgccuucuacgucaacaagaagaaccccaagggcaaggccaagaacgugcuccgggaggacaaagagcuguacagcguccugaccuugaucgggaagcugcgccacuggugcgugcacagcgaggagggccgggccgaguucuggcuguacaagcucgacgagcugaaggacgacuucaagaacgugcuggacgucguguacaaccgcccggucgaggagaucaacaaccgguucaucgagaacaacaagguaaacauccagauccucggcuccguguacaagaacacggacaucgccgagcugguccgcagcuacuacgaguuccugaucaccaagaaguacaagaacaugggguucucgaucaagaagcuccgggagagcaugcuggagggcaagggguacgcggacaaggaguacgauuccgugcgcaacaagcuguaccagaugaccgacuucauacucuacaccggcuacaucaacgaggacucugaccgcgccgacgaccuggugaacacgcugcggucaagccuuaaggaggacgacaagaccacugucuacuguaaggaggccgacuaccuguggaagaaguaccgcgaguccauccgcgagguggccgacgcccuggacggcgacaacaucaagaagcucagcaaguccaacaucgagauccaggaggacaagcugcgcaagugcuuuaucagcuacgcggacuccgugagcgaguucaccaagcugaucuaccuccugacgcgguuccuguccgggaaggagaucaacgaccucgucaccacccugaucaacaaguucgacaacauccgcagcuuccuggagaucauggacgagcucggccuggaccggaccuucacggccgaguacuccuucuucgaggggucaaccaaguaccuggccgagcucguggagcugaacuccuucgucaagagcugcagcuucgacaucaacgccaagcgcaccauguacagagacgcgcuggacauccucggcaucgaguccgacaagaccgaggaggacaucgagaagaugaucgacaacauccugcagaucgacgccaacggggacaagaagcugaagaagaacaacggccugcgcaacuucaucgccagcaacgugaucgacuccaaccgguucaaguaccucgugcgcuacggcaaccccaagaagauccgggagacggccaaaugcaagcccgccgugcgcuucguccugaacgagauccccgacgcgcagaucgagcgguacuacgaggccugcugcccgaagaacacagcccugugcagcgccaacaagcgccgugagaagcucgccgacaugaucgcggagaucaaguucgagaacuucuccgacgccgggaacuaucagaaggccaacgugaccagccgcaccuccgaggcggagaucaagcggaagaaccaggccaucauccgccuguaccugacggugauguacauaaugcucaagaaccuggucaacgugaacgcgcgcuacgugaucgcauuccacugcgucgagcgggacaccaagcuguacgccgaaaguggccucgagguggggaacaucgagaagaacaagaccaaccugaccauggccgugaugggcgucaagcuggagaacgggaucaucaagaccgaguucgacaaguccuucgcggagaacgccgccaaccgcuaccuccggaaugcccgcugguacaaacugauccuggacaaccucaagaaguccgagcgggccguggugaacgaguuccgcaacacggucugccaccugaacgcuauccggaacaucaacaucaacaucaaggagaucaaggagguggagaacuacuucgccuuauaccacuaccucauccagaagcaccuggagaaccgcuucgccgacaagaagguggagcgggacaccggcgacuucaucagcaagcuggaggagcacaagaccuacugcaaggacuucgucaaggccuacugcacccccuucggcuacaaccucgugcgcuacaagaaccugacaauugacgggcuguucgacaagaacuaccccggcaaggacgacagcgaugagcagaaggggucgggccccaagaaaaagcggaagguugccgcggccuacccguacgacguccccgacuacgccuga

SEQ ID NO: 14469 - RNA, 2964 nt, Artificial Sequence; identical to SEQ ID NO: 14329
  Cas13d variant__Eubacterium siraeum DSM15702__NLS-dEsCas13d-NLS-HA

SEQ ID NO: 14470 - RNA, 3402 nt, Artificial Sequence
  Cas13d variant__Eubacterium siraeum DSM15702__PspCas13b-NES(HIV)-3xHA
augaacauccccgcccugguggagaaccagaagaaguacuucggcaccuacagcgucauggccaugcucaacgcgcagaccgugcuggaccauauccagaagguggccgacaucgagggggagcagaacgagaacaacgagaaccugugguuccacccggucaugucccaucucuacaacgccaagaacggcuacgacaagcagcccgagaagacgauguucauaaucgaacgccugcagagcuacuuccccuuccugaagaucauggccgagaaccagcgggaguacuccaacgggaaguacaaacagaacagaguggaggugaacagcaacgacauauucgagguccucaagcgagccuucggcgugcugaaaauguaccgcgaccugaccaaccacuacaagaccuacgaggaaaagcucaacgacgggugcgaguuccugacauccacggagcagccccugagcggcaugaucaacaacuacuacacuguggcgcuccggaacaugaacgagcgcuacggcuacaagaccgaggaccuggccuucauccaggacaagcgguucaaguuugucaaggacgccuacgggaagaagaagucccaggugaacaccggcuucuuccugagccuucaggacuacaacggugacacgcagaagaagcugcaccuuuccggcgugggcaucgcccuccugaucugcuuauuccucgacaagcaguauaucaacaucuuccugagccgccugccgaucuucuccagcuauaaugcgcaguccgaggagcggcgcaucaucauccggagcuucggcaucaacucgaucaagcuccccaaggaucgcauccauagcgagaaguccaacaagagcgucgccauggacaugcugaacgaggugaagcgaugccccgacgagcuguucacuacccucuccgccgagaagcagagccgauuccguaucauaagcgacgaccacaacgagguguugaugaagagauccagcgaccgguucguuccccugcuccugcaguacaucgacuacggcaagcuguucgaccacaucagauuccacgugaacauggggaagcuccgguaccuguugaaagccgacaagaccugcaucgacggccagacccgcguccggguaaucgagcagccgcucaacggguuuggccgccuggaggaggccgaaaccaugcgcaagcaggaaaacggcaccuucgggaacuccggcauccggaucagagacuucgagaacaugaagcgggacgacgcgaacccugccaacuaccccuacaucguggacaccuacacgcacuacauccuggagaacaacaagguggagauguucaucaacgacaaggaggacagcgcgccccuccugccggucaucgaggacgaccgcuacguggugaagaccauccccuccugccgcaugucuacccucgagauccccgccauggccuuccacauguuccucuucggguccaagaagacagagaagcugaucgucgacgugcacaaccgcuacaagagacuguuucaggccaugcagaaggaggaggucacggccgagaacaucgccagcuucggcaucgcggaguccgaucucccccaaaagauccuggaccugaucagcgguaacgcgcacggaaaggacguggacgcguucauccgccucaccguggaugacaugcugaccgacaccgagcgccgcaucaagcguuucaaagacgacaggaaaagcauccggagcgccgacaacaagaugggcaagcgcggguucaagcagaucucuacgggcaagcuggccgacuuccuggccaaggacauaguccuauuccagccguccgugaacgacggggagaacaagauuaccggucugaacuacagaaucaugcagagugccaucgcgguguacgacagcggggacgacuacgaggccaagcagcaauucaaacugauguucgagaaggcccgccucaucgguaaaggcaccaccgagccccaccccuuccuguacaaggucuuugcucgguccaucccggcgaacgccguggaguucuacgagcgcuaccugaucgagcggaaguucuaccucacggggcugagcaacgagaucaaaaagggcaaccgcguggacgucccguucauacgccgggaccagaacaaguggaagacccccgccaugaaaacccucgggcgcaucuacucugaggaccuccccguggagcugccccggcagauguuugacaacgagaucaagagccaccucaagagccucccgcagauggagggcaucgacuucaacaaugccaacgugacguaccugaucgccgaguauaugaagcggguccuggaugacgacuuccaaacauucuaccaguggaaccggaacuaccgcuacauggacauguugaagggggaguacgaccggaagggcucccugcagcacugcuucaccagcguggaggagcgcgaaggccuguggaaggagcgggccucccgcacugagcgguaccguaagcaggccagcaacaagauccgguccaaccgccagaugcggaacgccagcuccgaggagaucgagaccauccucgacaagagacuguccaacucccggaacgaguaccagaaguccgagaaggugauccgccgguaccgcguccaggacgcccugcuguuccugcuggccaagaagacgcucacggagcuggcggacuucgacggagagagguucaagcugaaggagaucaugcccgacgccgagaagggcauccuaagcgagauuaugcccaugagcuucaccuucgagaagggugggaaaaaguacaccaucaccuccgagggcaugaagcugaaaaacuacggggacuucuuugugcuggccagcgacaagcgcaucggcaaccuccuggagcuggugggauccgauauugucagcaaggaggacaucauggaggaguucaacaaguacgaccagugccgccccgagaucuccagcaucguuuucaaccucgaaaagugggccuucgacacguaccccgagcugagcgcccggguggauagagaggagaaagucgauuuuaaguccauccugaagauccuccugaauaacaagaacaucaacaaggagcagagcgacauccugcggaagauccgcaacgcguucgaccacaacaacuaccccgacaagggcgugguggagauuaaggcccuccccgagaucgccauguccaucaagaaggccuucggggaauacgcgaucaugaagggcagccugcagcugccgccccucgagcggcugacacugggcuccucauaccccuacgacguccccgacuacgccuacccguacgacgugcccgacuacgccuaccccuacgacgugcccgacuacgccuga

SEQ ID NO: 14471 - RNA, 2748 nt, Artificial Sequence
  Cas13d variant__Gut metagenome assembly P1E0-k21__P1E0Cas13d-HA
auggaacgcgaagugaagaaaccaccaaagaaaucccucgccaaagcagccggccuaaaaagcacguuuguaauauccccacaagaaaaagaacucgccaugaccgccuucggacgcggcaacgacgcccugcuccagaaaaggaucgucgacgggguaguucgcgacgucgcuggcgaaaaacaacaauuucaaguucaacggcaagacgaaagccgcuuccggcuccaaaacucccgacucgcggaucgcacagucacggcagacgacccccugcacagagcugaaacaccacgacgccaaccacucggugcaggcauggaccaacuccgcaggaaagcaauccucgaacaaaaauacuucggacgcacauucgacgauaacauucacauccagcucaucuacaacauucuggacauccacaaaaugcucgccguacccgcgaaccacaucguacacaccuuaaacuuauuaggcggauacggcgaaacagauuucguuggaaugcucccagcaggccuccccuacgacaaacuccgcguagucaaaaagaaaaacggagacaccguugacauuaaagccgacauagccgcauacgccaaacgaccgcaacuggcauaccuuggagcggcuuucuacgacgucacccccggaaaaucgaaaagagacgccgcccgaggacgugucaaaagagaacaagacgucuacgccauccuaagccucaugucccuccuccgacaauuuugcgcccacgacagcguccgcauaugggggcaaaacaccacagccgcccucuaccaccuccaggcacucccccaagacaugaaagaccuccucgaugacggauggcgccgugcacuuggaggcgucaacgaccauuuccuagacacaaacaaagugaaccuccugacccuuuucgaguacuacggagccgagacgaaacaagcucgcgucgcauuaacacaagacuucuaccgauucgucgucuuaaaagaacagaaaaacaugggcuuuagccuccgacggcucagggaagaauuacuaaaacucccagacgcagcauaccucacuggacaagaauacgacagcgucagacaaaaauuguacaugcucuuggacuuccucuuaugccgacuauacgcccaagagcgcgcggaccguugcgaggagcuaguaagcgcacuccgaugcgcacucagcgacgaagaaaaagacacggucuaccaagcagaagccgccgcacucuggcaagcccuaggcgacacccuaagacgcaaacuacuaccacuacucaaaggaaagaaacuccaagacaaagacaaaaagaaauccgaugaacucggacucuccagagacguucucgacggaguccucuucagaccagcacaacaaggcucccgcgccaacgcagacuacuucugccgcuuaaugcaccuaucaaccugguucauggacgguaaagagauaaacacccuacucaccacccucauuucuaaacucgagaacauugacucccuccgcucgguccuggaaucaaugggauuagcauacucauucgugcccgccuacgccauguucgaccauagccgcuacauagccgggcagcuacgcgucgucaacaacaucgcccgaaugcgcaaaccggcaaucggagcuaaaagagaaauguaccgggcagcaguuguccuccugggcgucgacagccccgaagccgccgccgcuauaacagaugaccuccuacaaaucgaucccgaaacaggcaaaguccgcccccgaagcgacagcgcccgcgacaccgggcuaagaaacuuuaucgccaacaacgucguggaaucacgacgauuuaccuaccugcuacgcuacaugacacccgaacaagcgcgagucuuagcccaaaacgaaaaacuuauugcauucguccucuccacaguucccgauacucaauuagaacgcuacugcagaaccugcgguagagaagacaucaccggaaggcccgcccagauaagauaccuaacagcacaaaucaugggaguucgcuacgagagcuucaccgacguagaacaacgcggacgcggcgacaaccccaagaaagagcgauacaaagcgcuaauaggccuauaucuaacuguacucuaccuagcggucaaaaacaugguuaacugcaacgccagguauguaaucgcauucuacugccgagacagagacacggcccuauaucaaaaagaagucugcugguacgaccuggaagaggacaagaaauccgggaaacagaggcaaguggaagacuacacagcccuaaccagauacuuuguaucccaaggcuaccuaaacaggcacgcgugcggauaccuacgaucaaacaugaacggcaucuccaacucccuccuaaccgccuaccguaaugcagucgaccaucucaaugccauacccccucugggcagccucugcagggacauaggcagaguagacagcuacuucgcccucuaccacuacgcagugcaacaauaccucaacggccguuacuacagaaaaacaccccgagaacaggagcuauucgccgccauggcacaacaccgaaccuggugcagcgaccucgucaaagcacuaaacaccccguuuggauauaaccuggccagauauaaaaaccucuccauagacggccuauucgaucgagaaggggaccacguggucagagaggacggagagaaacccgcagaguacccuuacgacgucccggacuacgccuga

SEQ ID NO: 14472 - RNA, 2748 nt, Artificial Sequence
  Cas13d variant__Gut metagenome assembly P1E0-k21__dP1E0Cas13d-HA
auggaacgcgaagucaagaaaccgcccaagaaaucucucgccaaagccgccggacuaaaaagcaccuuugucaucuccccacaagagaaagaacuagccaugacagccuucggccgaggcaaugacgcccuccuucaaaaacggaucguagauggcguaguacgcgacguugcgggcgaaaaacagcaauuccagguccaaagacaggacgaaagccgcuucagacuacaaaacagccgccuagccgaccgcaccguaaccgcagacgacccccuccaccgagcugaaacuccccgacgacaaccccucggagcaggcauggaccaacucagacgcaaggccauauuggaacagaaauacuucgggagaacauucgacgacaacauucacauacagcucauauacaauauacuagacauccacaaaaugcucgccgugccagcuaaccacaucguccacacacuaaaccuacuuggcggguacggggaaacugacuucgucgggaugcuacccgcagguuugcccuacgacaaauuacgcguagucaaaaagaaaaacggcgauaccguagacaucaaggcagacauagcagccuacgccaaacgcccgcaacucgcauaucucggcgccgcuuuuuacgacgucacccccggaaaaagcaaacgcgacgcggcccgaggccggguaaaacgcgaacaagacgucuacgccauacuaucccucaugucccuccucgcacaauucugcgccgcagauuccguccgcaucuggggccaaaacaccacagccgcgcuauaccaucugcaggcacuuccccaagacaugaaagaccuacucgacgacggguggcggcgugcccuggguggggucaacgaucacuuucuagacaccaacaaagugaaccugcucacccuauucgaauacuacggugccgagacuaaacaagccagaguugcauuaacccaggacuucuaccgcuuuguaguccucaaagaacagaaaaacaugggcuuuagccucagaagacuccgagaagaacuccucaaacugccagaugccgcuuaccugaccggccaagaauacgacucgguccgacaaaaacuauacaugcuccucgacuuccuccugugccgucuauacgcucaggagcgcgccgaccgcugcgaagaacucgucuccgcacuacgcugcgcccuaucagacgaggaaaaagacaccguauaccaagccgaagcagcagcccucuggcaagcacucggcgacacccucagacgcaaacuccuccccuugcucaagggaaagaaacuccaagacaaagacaaaaagaaauccgacgagcucggacucucacgagauguacucgacggaguacuguuucgacccgcccagcagggaucccgcgccaacgccgacuacuucugccgccucaugcaccuuucaacaugguucauggacggcaaagaaaucaacacccuccucaccacacuaauaucuaaacucgaaaacaucgacucacuacgaagcguccuggaaucgaugggacucgcauacuccuucguacccgcauacgccauguucgaccacagccgguacauugcggggcaauugcgcgucgucaacaauauagcccgcaugagaaaacccgcaaucggagccaagagagaaauguaucgggccgccgucguccuccuuggagucgacagcccagaggcagcggcagccaucacagacgaccuccugcaaauagaccccgaaaccggcaaagucagacccagaagcgacuccgcgcgugacaccggccuccguaacuucaucgccaacaacgucguggaaucacgccgguucacauaccugcucagauauaugacccccgaacaggcaagaguucucgcccaaaacgaaaagcucaucgcguucguccuuaguaccguaccagauacacaacuagaacgauacugcagaaccugcgggcgcgaagacaucacgggcagaccagcacaaauccgauaucuaacggcccaaaucaugggaguccgcuacgaaucauucaccgacguagaacaacgcggccgcggagacaacccaaagaaagaacgcuacaaagcccucauuggacuguaucuaacgguacucuaccucgcagucaaaaacauggucaacugcaacgcaagauacgugaucgcuuucuauugccgcgacagggacacagcccucuaccaaaaagaagugugcugguacgaccuagaagaagacaagaaauccggcaaacaaagacaaguggaagauuacaccgcccuaacccgauacuucgucucacaaggcuaccuaaaccggcacgccugcggcuaccuacgcuccaacaugaacgggaucuccaacucacuacucaccgcguacgccaaugccguugaugccuuaaaugcgauacccccucuuggaucacuuugucgcgacaucggacgcgucgacucauauuucgcccucuaccacuacgccguccaacaguacuugaauggaagguacuaccgcaaaacaccccgcgaacaagaauuauucgccgccauggcacagcacagaacuuggugcagcgaccucguaaaagcccucaacaccccauucggcuacaaccuagcacgcuacaaaaaccuuagcaucgauggcuuauucgaucgcgaaggagaccacgucguacgugaagacggcgagaaaccggccgaauaccccuacgacgucccagacuacgcauga

SEQ ID NO: 14473 - RNA, 2820 nt, Artificial Sequence
  Cas13d variant__Gut metagenome assembly P1E0-k21__NLS-P1E0Cas13d-NLS-HA
auguccccgaaaaagaaacgcaaagucgaagcgucagagcgcgaaguaaagaaaccgccaaagaaaagccuagccaaagcggcuggccucaaaucaacguucgugauaaguccccaagaaaaagaauuagccaugaccgcauucggacgcggcaacgacgcacuacuacaaaagagaaucguggacggggucguaagagacgucgccggcgagaagcaacaauuccaaguccagcgacaggacgaaucccgcuuccgacugcaaaacucccgacuggcggaccgaaccguaacugcggacgacccgcuacacagggcggaaacaccccgacgccaaccccucggggccggcauggaccaacuaagacggaaagcuauacuagaacaaaaauacuucggccgcaccuuugacgacaacauccacauacaacuaauauacaacauccucgacauccacaagaugcucgcaguaccagcaaaccacauagugcacacacucaaccuacuaggaggauacggagaaaccgacuucgucgguaugcuacccgcaggccucccauacgacaaacuccgagucgucaagaagaaaaacggggacacaguggacaucaaagcagacaucgcugccuacgcaaaacgaccacaacucgcguaccucggagcugcuuucuacgauguaacccccggcaaaucaaaaagagacgcagccagagggagagucaaacgggaacaagacguauaugccauacuaucccugaugucccuucuaaggcaauucugcgcacacgacuccgugcgcaucuggggucaaaacaccaccgccgcacuguaccaccuccaagcacucccccaggacaugaaagaccuucuggacgacggauggcgcagagcacucggcggaguaaacgaccacuuccuagauaccaacaaagucaaucuccucacccucuucgaauacuacggugccgagacaaaacaagcccgcgucgcccuaacacaggacuuuuaccgcuucguaguucucaaggagcagaaaaacaugggcuuuucacuucgcagacucagagaggaacugcugaaacuacccgacgcugccuaccucaccggacaagaauaugacagcguccgacaaaaacuguacaugcuucuugacuuccuacuaugcagacuuuacgcccaagaacgcgcggauagaugugaggaacucguaucugccuuaagaugcgcacugucagacgaagaaaaagacacaguauaccaggcggaagccgcugcacucuggcaagcccuaggcgauacacuccgccgcaaguugcuccccuuacucaaaggcaagaaacuacaagacaaagacaaaaagaaaagcgacgaauuaggccucucaagagacgugcuugacggcguccuauuccgccccgcacaacagggcagccgagcaaacgcagacuacuucugccgucugaugcaccuaagcaccugguucauggacggcaaagaaaucaacacauuacuuacuacccuaaucucaaagcuagaaaauauagacucacuccgaagcguccucgaaucgaugggacucgccuacucauucgucccggccuacgcaauguucgaccacucgcgauacauagcuggccaacuucggguagugaacaacaucgccagaaugagaaaaccggccauaggagccaaacgggaaauguaccgcgccgcaguagugcuucuuggcguagacucgcccgaggccgccgcagccauaaccgacgaucuucuacaaaucgaccccgaaaccgguaaagucaggccccgcagcgacagcgccagagacaccggccuccgcaacuucauugccaacaacguaguagagagccgcagguucacauaucuccuccgcuacaugacaccagaacaagccaggguacuagcccaaaaugaaaagcugauagcauuuguacuauccacaguccccgacacccaacucgaacgcuacugccgcacgugcggccgugaggauaucacagggcgaccagcccaaaucagauaccuaaccgcccaaauaaugggcgucagauacgaaucguucacagacguagaacaacguggccgcggggauaaccccaaaaaggaacguuacaaagcacuaaucggccuauaccugaccgugcuguaccuggcagugaagaacauggucaacugcaaugccagguacgucauagcauucuacugcagagaccgagacaccgcacuguaccaaaaagaggugugcugguacgaccuggaagaggacaagaaauccggcaaacaaagacaagucgaagacuacacagcacuaacccgcuacuucgucagccaaggcuaccuaaaccgacacgccugcggcuaccugcggagcaacaugaacggaaucucaaacucgcuacucaccgcauaccgcaacgccgucgaccaucucaacgcaauaccaccccuaggaucacucugcagggacauagggagaguagacuccuacuucgcacucuaucacuacgcaguccaacaauaccuaaaugggcgcuacuaccgcaagacaccaagggaacaagaacucuucgccgcaauggcccaacacagaaccuggugcagcgaccucgucaaggcacucaacacacccuucggauacaaccuggcaagauacaaaaaccugucaaucgacggucuauucgaccgcgaaggagaccacguuguccgggaagacggcgaaaaaccggcagaaggcuccggccccaaaaagaaacggaaagucgccgccgcauauccauaugacguaccggacuaugcauga

SEQ ID NO: 14474 - RNA, 2820 nt, Artificial Sequence
  Cas13d variant__Gut metagenome assembly P1E0-k21__NLS-dP1E0Cas13d-NLS-HA
augucgcccaaaaagaaacgcaaaguagaggcuucagaacgugaagucaagaaaccuccaaagaaaucacuagccaaagccgccggucucaaauccacauucgugaucagcccccaggaaaaagaacuagcuaugacagcuuucggccgcgggaacgaugcacucuuacagaagcggaucgucgacggcgucguccgcgacguggccggggaaaaacaacaauuccaaguccaacggcaagacgaaucucgcuucagacuacaaaauagccgacuugcagaccgcacagugaccgccgacgacccccuacaucgcgccgagaccccucgccgacaaccuuuaggagcgggcauggaccaacuccgccgaaaagccauacuagaacaaaaauacuucggccguaccuucgaugacaacauccacauccaacucaucuacaacauacuggacauacacaaaaugcuagccguccccgcgaaccacaucgugcacacccucaaccuacucggcggauauggcgagacggacuucguaggcaugcuccccgcaggccuccccuacgacaaacugcgcguagucaaaaagaaaaacggagacacggucgacauaaaagcggacauagccgcauacgcaaaacgcccccaacucgccuaccuaggagccgccuuuuacgacgucacaccaggaaaaagcaaacgagacgcggccagaggccgggucaaaagggagcaagacguuuaugccauacucucacucaugucacuacucgcccaauuuugcgccgcugacagcguucguauauggggacaaaacacgacggcagcguuauaccaccuccaggcccuuccccaagauaugaaagaucuacuagaugacggauggcgacgugcccugggaggcguuaacgaucacuuccuggauacuaauaaagucaaucuacucacacuguucgaauacuacggcgcugagacaaaacaagcacgaguagcacuaacccaagacuucuaccgcuuuguuguccuaaaagaacagaaaaacaugggcuucucccugcgccgccuccgagaagaacuccuaaaacuacccgacgcagccuacuuaaccggccaagaguaugacuccguacgccaaaaacucuacaugcuccucgacuuccuccugugccgacuauacgcucaagaaagagccgaccgcugcgaggaacucguauccgcgcuacgaugcgcccucucagacgaagaaaaagauacagucuaccaagccgaagcagccgcccuauggcaagcacucggcgacacccuaagaagaaaacuccucccccugcucaaaggcaagaaacugcaggacaaagacaaaaagaaaucugacgagcuuggacuauccagagauguccuggacggcguucucuuccggcccgcacaacaaggcucccgagccaacgcagacuauuucugccgacugaugcaccucagcacaugguucauggacgguaaagaaaucaacacccuacucaccacacucaucagcaaacuagaaaacaucgacagccuacgcagcguccuagaauccaugggacuggccuacucuuucgucccagcguacgcgauguuugaccacagcagauacauagccggccaacuacgaguugucaacaacauagcccguaugcgcaaacccgcaaucggcgcaaaacgggaaauguacagagccgccguaguacuccuagguguagacuccccugaagcagccgccgccaucacagacgaccuacuccaaauugaccccgaaacaggcaaaguccggccacgauccgacucagcacgcgauacaggccuccgaaacuucaucgcaaacaacguuguagaaucccggcguuuuacauaccuacuccgcuacaugacaccagagcaagcccgagugcucgcccaaaacgaaaaacuuaucgccuucguucucaguaccguucccgauacccaacuagaacgcuauugccgaaccugcggcagagaagacaucaccggucgccccgcccagauccgcuaccucacagcacagauaaugggagugcgauacgaaucauucacagacguggaacagcgagggcgaggggacaaccccaaaaaggagcgguacaaagcgcucauagggcuauacuuaacaguacucuaccuggccgucaagaacauggucaacugcaacgcaagauacgugauagcguucuacugccgcgaccgagacacagcccuauaccagaaagagguaugcugguaugaccuggaagaagauaagaaauccggcaaacagcgacaaguagaggacuacaccgcccuaacccgauauuuugucucccaaggcuaccuaaaccggcacgccuguggauaccucagaucaaacaugaacggcauaucuaacagccuccucaccgcauacgcaaacgcggucgacgcccuuaacgccauaccuccccucggaucccuuugccgcgacauugggaggguggacuccuacuucgcgcuuuaccacuacgccguccaacaauaccuaaacggcagguacuacagaaaaaccccaagagaacaagaacucuucgcggccauggcccaacacaggaccuggugcagcgaccucgugaaagcccuaaauacccccuucggguacaaccucgcgagauacaaaaaccucucaauugauggccucuucgacagggaaggagaccacguaguucgugaagacggcgagaaacccgcagagggcuccggcccgaaaaagaaacggaaagucgccgcagccuacccuuaugacguccccgauuacgcguga

SEQ ID NO: 14475 - RNA, 2862 nt, Artificial Sequence; identical to SEQ ID NO: 14335
  Cas13d variant__Ruminococcus albus __RaCas13d-HA

SEQ ID NO: 14476 - RNA, 2934 nt, Artificial Sequence; identical to SEQ ID NO: 14336
  Cas13d variant__Ruminococcus albus __NLS-RaCas13d-NLS-HA

SEQ ID NO: 14477 - RNA, 2829 nt, Artificial Sequence; identical to SEQ ID NO: 14337
  Cas13d variant__Ruminococcus flavefaciens FD1__RffCas13d-HA

SEQ ID NO: 14478 - RNA, 2901 nt, Artificial Sequence; identical to SEQ ID NO: 14338
  Cas13d variant__Ruminococcus flavefaciens FD1__NLS-RffCas13d-NLS-HA

SEQ ID NO: 14479 - RNA, 2931 nt, Artificial Sequence; identical to SEQ ID NO: 14339
  Cas13d variant__Ruminococcus flavefaciens XPD3002__RfxCas13d-HA

SEQ ID NO: 14480 - RNA, 2931 nt, Artificial Sequence
  Cas13d variant__Ruminococcus flavefaciens XPD3002__dRfxCas13d-HA
augaucgagaagaagaaguccuucgccaagggcaugggggucaaaagcacccuggugagcggcuccaagguguacaugaccacuuucgccgagggguccgacgcgcgccucgagaagaucguggagggcgacuccauccggagcgucaacgagggggaggccuuuuccgccgaaauggccgacaagaacgccggcuacaagaucggcaacgcgaaguucagccaccccaagggguacgccgugguggccaacaacccgcuguacacaggccccguccagcaggacaugcugggccucaaggaaacccuggagaagcgcuacuucggcgaguccgccgacgggaacgacaacaucugcauccaggugauccacaacauccuggacaucgagaagauccucgcggaguacaucaccaacgcggccuacgccgugaacaacaucaguggccuggacaaggacaucaucggcuucgggaaguucuccacagucuacaccuacgacgaguucaaggaccccgagcaccaccgggccgcguucaacaacaacgacaagcugaucaacgccaucaaggcccaguacgacgaguucgacaacuuccucgacaacccccgccugggcuacuucgggcaggccuucuucagcaaggagggccggaacuacaucaucaacuacggcaacgagugcuacgacauccuggcccuccuguccgggcuggcgcacugggugguggccaacaacgaggaggagagccgcauaucccggaccuggcucuacaaccuggacaagaaccuggacaacgaguauaucagcacccucaacuaccuguacgaccgcaucacgaacgagcugaccaacuccuucagcaagaacuccgccgcuaacgucaacuacaucgccgagacccucggcaucaacccggcggaguucgccgagcaguacuuccgguucaguaucaugaaggagcagaagaaccugggguucaacaucaccaagcugcgcgaggugaugcucgaccggaaggacaugagcgagauccgcaagaaccacaagguguucgacuccauccggacgaaggucuacaccaugauggacuucgugaucuaccgcuacuacaucgaggaggacgccaagguggccgccgcgaacaagagccugcccgacaacgagaagucccugagcgagaaggacaucuucgucaucaaccuccggggcuccuucaacgacgaccagaaggacgcccuguacuacgacgaggccaaccgcaucuggcggaagcuggagaacauuaugcacaacaucaaggaguuccgcgggaacaagacccgggaguacaagaagaaggacgcgccccgccucccccggauacugccggccggccgcgacgugagcgccuucuccaagcucauguacgcccucaccauguuccuggauggcaaggagaucaacgaccugcucacgacccugaucaacaaguucgacaacauccagagcuuccugaaggugaugccgcucaucggggucaacgccaaguucguggaggaguacgccuucuucaaggacuccgcgaagaucgccgacgagcugcgccugaucaagagcuucgcccggaugggcgagcccaucgccgacgcucgccgggcgauguacaucgacgccauccgcauccuugggacaaaccuguccuacgacgagcugaaagcccucgccgacaccuucagccuggacgagaacggcaacaagcugaagaaggggaagcacggcaugcggaacuucaucaucaacaacgugaucuccaauaagcgcuuccacuaccucauccgguacggcgaccccgcgcaccuccacgagaucgcgaagaacgaggccgucgugaaguucguccuggggcgcaucgccgacauccagaagaagcagggccaaaacgggaagaaccagaucgaccgguacuacgagacgugcaucggcaaggacaagggaaagagcguguccgagaagguggacgcccugaccaagaucaucaccgggaugaacuacgaccaauucgacaagaagcgcagcgucauagaggacacaggccgggagaacgcggagcgcgagaaguucaagaagaucaucucccuguaccugacggugauuuaccacauccugaagaacaucgugaacaucaacgcacgguacgucaucggguuccacugcguggagcgcgacgcccaacucuacaaggagaagggcuacgacaucaaccugaagaagcuggaggagaagggguucagcuccgugaccaagcucugcgccggcaucgacgagaccgccccggacaagcggaaggacgucgagaaggagauggcggagcgcgccaaggagagcaucgacagccuggaguccgccaaccccaagcuguacgccaacuacaucaaguacagcgacgagaagaaggccgaggaguucacccggcagaucaaccgcgagaaggcgaagacggcccucaacgccuaccugcggaacaccaaguggaacgugaucauccgcgaggaccugcuccgcaucgacaacaagaccugcacccuguucgccaacaaggccguggcgcuggagguagcccgguacgugcacgcauacaucaacgacaucgccgaggugaacuccuacuuccagcucuaccacuacaucaugcagcgcaucaucaugaacgagcgguacgagaaguccagcggcaaggucagcgaguacuucgacgcggugaacgacgagaagaaguacaacgaccgccuacugaagcuccugugcgugcccuuuggguacugcaucccccgguucaagaaccuguccauagaggcccucuucgaccgcaaugaggccgccaaguucgacaaggaaaagaagaaggucagcggcaacuccuauccguacgacgugcccgacuaugccuga

SEQ ID NO: 14481 - RNA, 3003 nt, Artificial Sequence; identical to SEQ ID NO: 14341
  Cas13d variant__Ruminococcus flavefaciens XPD3002__NLS-RfxCas13d-NLS-HA (CasRx)

SEQ ID NO: 14482 - RNA, 3003 nt, Artificial Sequence; identical to SEQ ID NO: 14342
  Cas13d variant__Ruminococcus flavefaciens XPD3002__NLS-dRfxCas13d-NLS-HA (dCasRx)

SEQ ID NO: 14483 - RNA, 3381 nt, Artificial Sequence; identical to SEQ ID NO: 14343
  Cas13d variant__Ruminococcus flavefaciens XPD3002__hnRNPa1-dCasRx-HA

SEQ ID NO: 14484 - RNA, 2787 nt, Artificial Sequence; identical to SEQ ID NO: 14344
  Cas13d variant__Uncultured Ruminococcus sp. __UrCas13d-HA

SEQ ID NO: 14485 - RNA, 2787 nt, Artificial Sequence; identical to SEQ ID NO: 14345
  Cas13d variant__Uncultured Ruminococcus sp. __dUrCas13d-HA

SEQ ID NO: 14486 - RNA, 2859 nt, Artificial Sequence; identical to SEQ ID NO: 14346
  Cas13d variant__Uncultured Ruminococcus sp. __NLS-UrCas13d-NLS-HA

SEQ ID NO: 14487 - RNA, 2859 nt, Artificial Sequence; identical to SEQ ID NO: 14347
  Cas13d variant__Uncultured Ruminococcus sp. __NLS-dUrCas13d-NLS-HA

SEQ ID NO: 14488 - RNA, 4275 nt, Artificial Sequence; identical to SEQ ID NO: 14348
  Cas13d variant__Leptotrichia wadei __NLS-LwCas13a-msfGFP

SEQ ID NO: 14489 - RNA, 4275 nt, Artificial Sequence; identical to SEQ ID NO: 14349
  Cas13d variant__Leptotrichia wadei __NLS-dLwCas13a-msfGFP

SEQ ID NO: 14490 - RNA, 2868 nt, Artificial Sequence
  Cas13d variant__Anaerobic digester metagenome 15706__AdmCas13d-HA
augaacaacaaaagaaaaacaaaagcaaaagcagcaggucucaaaagcguauucuuugaucaaaaacaagccgucuuaaccacauucgcaaaaggaaacaauucacaaauugaaaaaaaaguaguuaacuccgaaguaaaagaucucagacaaccuccugcauuugaucuagaauuaaaagaaaaaacuuuuuauauaagcggaaaaaacaacauaaacacaucaagagaaaacccccuagcuucugccucccuuccacuuagcaaacgccaacgaauucgagcagaacgcauaaaaagagcacgagaagaaaaccguccauaccauaaugugaaaagaguuggcgaagaugaccuaagagcaaaagcagaccuagagaaacacuauuucggaaaagaauacucagacaaccuaaaaauucaaaucauuuacaacauacucgauauaaauaaaauuauauccccauacaucaaugacauaguauacuccaugaacaacuuagcaagaaacgaugaauacaucgacggcaaaauagacguaauaggcuccuuaucaucaacaacagauuauuccucauuuauguccccaaacaaagaccuagaaaaagaaaaaaaauucuccuuccacagagaaaauuacaaaaaauucguagaagcgucaaaaccauacaugcgcuauuauggcaaaguauuuauaagagacguaaaaaaaucuaaacuuuccaccggcaaaggagaaaaaauagaagucauguacagaucugaugaagaaauauuuacaaucuuucaaauccuuucauacgugagacaaucaauaaugcacaaugauauaggaaauaaaucgucaauucucgcgauagaaaaauauccagccagauuuguuggauuccuaucagaucuacuaaaaacaaaaacaaacgacgucaauaggauguucauagauaacaacucccaaacgaacuucuggguacuauucucaauauuuggacuacaagaccauacuucaggcgccgauaaaauaugcagaaauuuuuaugauuucguaauuaaagccgauucaaaaaaccucggcuucuccuuaaaaaaaaucagagaacuaaugcuugacuuacccaacgccaauauguuaagagaucaccaauucgacacaguaagaaguaaauuuuacacacuauuagauuucauaauauaucaacacuaucuagaagaaaaaucgcgaauagacaacauggucgaaaaauuaagaaugacacuaaaagaagaggaaaaagaaguauuauaugcugcagaagccaaaauagucuggaaugcuauaggugcuaaaguaauaaacaaauuaguuccaaugaugaauggagacgcuuuaaaagaaauuaaaagaaaaaacagagacagaaaauuaccucaaagugucauagccacaguacaaguaaauucugacgcaaacgucuucucuggacuaauauauuuuuuaacacuauucuuagacggaaaagaaaucaacgaaaugguaagcaacuuaauaacuaaauuugaaaacauagauucccuacuccacguagacagagaaauauauaaaucugacgaaaaagaccuagaccuugaaauagaaaagcuagcauuauucuuuaaagguguuguacgaccaaacgcuaaaacagauaccggugcuggagaaauuucgaaaucauuuagcaucuuccaauccgccgaaagaauuaucgaagaacucaaauuuaucaaaaacguaacacgcauggauaacgaaauuuucccauccgaaggaguauucuuagaugcagcgaacguucuuggcguacggggagacgacuucgacuuuucaaaugaauuuguaggagaugacuuacacucagacgccaauaaaaagaucauaaauaaaaucaacggaacuaaagaagacagaaaccuaagaaauuuuauuauuaauaacgucguaaaaucacgacguuuccaauauauugccagacacaugaauacacacuacguaaaacaauuagcuaauaacgaaacacucaacagauuuguccucaauaaaaugggagacgcaaaaauaauaaaucgauauuacgaaucuauaucuggaaacaccccaaacauagaaguuagaucacaaauugacuaccuaguaaaacguuuaagaucauuuucauuugaagacuuaaacgauguaaaacaaaaaguccgccccggaacuaaugaaucaauagaaaaagaaaaaaaaaaagcacucguaggacuaugccuaacuauacaauacuuaguuuacaaaaaucuaguaaacaucaacgcuagauacacaaccgcauucuauuguuuagaaagagacucaaaacuaaaaggcuuuggaguagaugucuggcgagacuucgagucuuacacugcccuaacuaaucauuuuauaaaagaaggcuacuugcccguuagaaaagcagagauacuacgagccaaccuaaaacaucuagauugcgaagacggauuuaaauauuacagaaaccaaguaacacaccuaaacgccauucgaguagcuuacaaauacaucaacgaaauuaaaucaguccauagcuacuuugcacuauaccacuauauaaugcaacgucaucucuaugauucacuccaagcaaaagcaaaagacagcucagguuucgucauagacgcacuaaaaaaaaguuucgaacauaaaauauacuccaaagacuuacuccacguccuacauucuccauuuggauauaacacugcccgauacaaaaaccuaucaauagaagcccucuuugacaagaacgaaagucgcccggagguuaacccuuuaucuacaaaugacuacccuuaugacguaccagacuacgcauga

SEQ ID NO: 14491 - RNA, 2868 nt, Artificial Sequence
  Cas13d variant__Anaerobic digester metagenome 15706__dAdmCas13d-HA
augaacaacaaaaggaagacaaaagcuaaagccgcuggccuaaaaucaguauucuuugaccaaaaacaagcgguacuaacaaccuuugccaaaggcaauaauucacaaauagaaaagaaagucgugaacuccgaaguaaaagacuuaagacaaccacccgccuuugaccucgaacucaaagagaaaacauucuacauauccggcaaaaacaauauaaacacaucucgagaaaauccauuagcuucagcuagucuaccucuaagcaaaagacaaagaauuagagcagaaagaauaaaaagagcccgagaagaaaauagaccauaucauaacgucaaaagaguaggagaagacgauuugcgagcaaaagcagacuuagaaaaacauuacuucggaaaggaauacucugauaaccuaaaaauccaaauaauauacaacauuuuagacauaaacaagauuauuaguccuuacaucaacgauauaguuuauucaaugaacaaccuugcaagaaacgacgaauacaucgacggaaaaauagacguaauaggaucacuauccagcacaacagacuauuccucauuuaugucacccaacaaagacuuagaaaaagaaaagaaauucucuuuccacagagaaaacuacaagaaauucguugaagcauccaaaccauacaugagauauuauggcaaaguauuuauaagggaugucaagaaauccaaacuaagcacaggcaaaggagagaaaauagaagucauguacagaucagaugaagaaaucuuuacaauauuccaaauacuuucuuacguagcacaaucaauaauggcaaacgacauuggaaacaaaucaucaauacucgcuauagaaaaauacccagcuagauuuguaggauuccuaucagacuuauuaaaaacaaaaaccaaugauguaaacagaauguucauagacaauaacucccaaacaaacuuuuggguauuauucagcauauuuggacugcaagaccacaccucaggagcggacaaaaucugcagaaauuuuuaugacuuugucaucaaagccgauucuaaaaaucuaggauuuucacuaaagaaaauccgagaacuaaugcuagauuuaccuaaugccaacaugcuaagagaccaccaguucgacacaguaagaucaaaauuuuacacccuauuagauuuuaucaucuaucaacauuaucuugaagaaaaaucaagaauagacaacaugguagaaaaauuaagaaugacccuaaaagaagaagaaaaagaaguacucuacgcagccgaagccaaaauaguauggaaugcuauuggugcaaaaguaaucaacaaauuaguaccaaugaugaauggcgaugcucugaaagaaauaaaaaggaaaaauagagauagaaaacuaccacaaaguguuauagcaacuguacaagugaacucagaugcaaacgucuuuucaggucugaucuacuuuuuaacacuauuuuuggacggaaaagaaauaaaugaaaugguaagcaaccuaaucacaaaauuugaaaacaucgauagccuguuacacguagacagagaaauauauaaaucagacgaaaaagaucuagaccuagaaauagaaaaacuugcacuauucuucaaaggaguaguucgaccaaacgcuaaaacagacacuggagcaggagaaaucucaaaaucauucucuauauuucaauccgcagaaagaaucauagaagaauuaaaauuuauuaaaaaugucacacguauggacaacgagauauucccaucagaagguguuuuccuugaugcagccaacguacuaggugucagaggagacgauuucgacuuuucaaaugaguucguaggugaugaccuucacagcgacgcuaauaagaaaauuauaaacaaaaucaacggaacaaaagaagaccgaaacuuaagaaauuuuauuauuaacaacguagucaaaagcagaagauuucaauacaucgcacgccauaugaacacucacuaugucaaacaacuagcaaacaacgaaacacuaaauagauucguauuaaacaaaaugggcgaugcaaaaaucauaaauagauacuacgaaagcauaagcggaaacacuccaaauauagaaguuagaagccagauagauuaccuaguaaaaagacuacguuccuuuucauucgaagaccuuaacgauguaaaacaaaaaguuagaccaggaacaaacgaaucaauagaaaaagagaaaaagaaagccuuaguaggcuuaugcuuaacaauacaauaccuaguuuacaaaaacuuaguaaacauuaaugcccgauacacuacagcauuuuauugccuugaaagagacagcaaacuuaaaggguucggcguugacguauggcgagacuucgaaucauacacggcauuaacgaaucacuucauaaaagaaggauaucucccaguaagaaaagccgaaauacugagagcaaaucuaaaacaccuugacugugaagauggcuuuaaauacuacgccaaccagguaacagcccucaacgccauacgaguagcauacaaauacaucaacgaaauaaaaagcguacauucauacuucgcccucuaccacuacaucaugcaacgacacuuauacgacucacuacaagcaaaagcuaaagauucaucaggauuuguaauugacgcucucaagaaaucauuugaacacaaaauauacucaaaagaccugcuccauguccuacauucccccuuugguuacaacacagcucguuacaaaaaccuauccauagaagcacuauuugacaaaaacgaaagucgaccugaaguaaacccucuaucaaccaacgacuaccccuaugacguacccgauuacgcauga

SEQ ID NO: 14492 - RNA, 2940 nt, Artificial Sequence
  Cas13d variant__Anaerobic digester metagenome 15706__NLS-AdmCas13d-NLS-HA
augucacccaaaaagaaacgcaaaguagaagccagcaauaacaaaagaaaaacuaaagcaaaagcugcuggucuaaaaagcguauucuucgaucaaaaacaagcuguauuaacuaccuucgcaaaaggaaauaacucacagauagaaaagaaagugguaaauagugaaguaaaagacuuaagacaaccaccagcauucgacuuggaauuaaaagagaaaaccuucuacaucagugggaaaaacaauauaaacaccagccgcgaaaauccacuagcaagcgcgucauuaccacuaucaaaacgacagagaauuagagcagaaagaauaaaaagagcacgugaagaaaacagaccguaccauaacguuaaacgugucggagaagaugaccuuagagcuaaagcagauuuagaaaaacacuacuucggaaaagaauacucagacaauuuaaaaauacaaauaauuuacaacauauuagauaucaauaaaauuauaucgccauauauaaaugauauagucuauagcaugaacaaccuagcaagaaaugacgaauacauagauggaaaaaucgaugucaucggaagucucucaagcacaacagauuacucguccuuuaugaguccgaauaaagaccuagaaaaagaaaagaaauucagcuuccacagagaaaacuauaagaaauuuguugaggcaagcaaaccauacaugcguuauuacggaaaaguauucauaagggacgugaagaaaucaaaauuaagcaccggaaaaggcgagaaaauugaaguaauguaccguucagaugaagaaaucuucacaauauuccaaauacuauccuauguacgacaaucuauuaugcacaacgauauaggcaauaaaaguagcauauuagcaauugaaaaauaucccgcaagauucguaggauuucucagcgaccuacucaaaacaaaaacaaaugacguaaauagaauguucaucgacaauaauagccaaacaaauuuuuggguacuauucucaauauucggacuacaagaccacacuucaggcgcagacaaaauaugucgaaauuucuacgacuucguaauaaaagccgacucgaaaaaucucggauucucauuaaagaaaauaagagaacuaauguuagaucuuccuaaugccaauauguuacgagaucaccaauucgacacaguaagauccaaauucuacaccuuacucgauuucauaaucuaccaacacuaucucgaagaaaaaucuagaauagacaauaugguugaaaaacuaagaaugacucuaaaagaagaagaaaaagaaguacuuuaugccgcagaagcaaaaauuguauggaacgccauuggagcgaaagugauuaauaaacuuguaccuaugaugaauggggacgcguuaaaagaaauuaaacggaaaaauagagacagaaaauuaccucaaagcguaauagccacuguacaaguaaauagugacgcaaacguauucuccggacugauauauuuccuuacguuguuccuagaugguaaagaaauaaacgaaaugguaucaaauuuaauaaccaaauuugaaaacauagauucacuauuacacguagacagagagauauacaaaucagaugaaaaagaccuagaccuagaaaucgaaaaacuagcauuauucuuuaaaggcguaguuagaccaaacgcuaaaacagauacaggcgcaggagaaauaucaaaaucauucagcauuuuccaaagcgcagaaagaauaauagaagaacuaaaauuuauuaaaaacguaacacgaauggauaaugagauauuuccaucagaaggggucuuccuagacgccgcaaacguauuagguguacguggagaugauuuugauuuuucaaacgaauuuguuggugaugauuuacacucagacgcuaauaagaaaauaauaaacaaaauaaacggaacuaaagaagacagaaaccuaagaaauuucauaauaaacaacguugucaaaucaagaagguuccaauacauagcaagacacaugaauacacacuauguaaaacaauuggcaaauaaugaaacacucaauagauuuguauuaaauaaaaugggagacgcgaaaaucaucaauagauauuaugaaucaauaucagggaauacaccuaacauagaagucagaucacaaauagacuauuuggucaaaagacuucgcagcuucucauucgaagaucuaaacgauguaaaacaaaagguccguccaggaacuaacgaaucaaucgaaaaagaaaagaagaaagcccuaguaggauuauguuuaacaauucaauacuugguuuauaaaaauuuaguaaauauaaacgcaagauacacuaccgcauucuacugccuagaaagagacagcaaacuuaaagguuucggaguagauguauggagagacuucgaauccuacacagcauuaaccaaccacuuuauaaaagagggcuaucuaccaguaagaaaagcagaaauauuaagagcaaaucuaaaacaccuagacugcgaagacggauucaaauauuaccggaaccaaguaacacacuuaaaugcaauccgagucgccuacaaauauauaaaugaaauaaaaucaguacacucauacuuugcccuauaccacuacauuaugcaaagacaccuauaugauucacuacaagcaaaagcaaaagacucuuccgguuuugucauagaugcacucaaaaagagcuucgaacacaaaauuuauucaaaagacuuacuacacguccuccacucuccauucggauauaacacagcuagauauaaaaaucugucaaucgaagcauuauucgacaaaaacgaaaguagaccugaaguaaacccuuuaucuacaaacgacggcaguggaccaaagaagaaacgaaaaguagcagcggcuuauccauaugacgucccagacuaugcauga

SEQ ID NO: 14493 - RNA, 2940 nt, Artificial Sequence
  Cas13d variant__Anaerobic digester metagenome 15706__NLS-dAdmCas13d-NLS-HA
augucaccaaagaagaaacgcaaaguagaagcaaguaacaauaaaagaaaaacaaaagccaaagcugcuggauuaaaaucaguauuuuucgaccaaaaacaagcaguacuaacuacuuucgcaaaaggaaauaacucacagauugaaaagaaagugguaaacagugaagucaaagacuuaaggcaaccaccagcauuugaccuagaacuaaaagagaaaacuuuuuacauuuccggcaaaaacaauauaaauaccucacgugaaaacccacuagcaucagcuagcuuaccacuaucaaaacggcaacgcauuagggcagaaagaauaaaacgugcacgggaagaaaaucgucccuaccacaacguaaaaagaguuggagaagaugacuuaagagccaaagcagaccucgaaaaacauuacuuuggaaaagaauauagcgacaaccuaaaaauacaaauuaucuacaauaucuuagauauaaauaaaauaauaucacccuauauaaacgacauaguauacucaaugaauaaccuagcaagaaacgaugaauacauagauggaaaaauagaugugauaggaucccuauccucaacuacagauuacaguaguuuuaugagcccgaacaaagaccuugaaaaagaaaagaaauuuuccuuccauagagaaaauuacaagaaauuuguagaagcgucaaaaccuuacaugcgcuacuacggcaaaguuuuuauaagagauguaaagaaaucaaaacuaucaaccggcaaaggagagaaaauugaagucauguaucguagugaugaagaaauauucacaauauuccaaauucuuagcuacguagcucaauccauaauggcaaacgacauuggaaacaaaucaucaauccuggcaauagaaaaauauccagcucgauucgucggauuucugucagaccuauuaaaaacaaaaacaaacgacguaaauagaauguucauugacaauaauucacaaacaaacuuuuggguauuauucucaauauucgguuugcaagaucacacuucgggagcggacaaaauuugcagaaauuucuacgauuuuguaauaaaagccgauuccaaaaauuuaggguucucauugaagaaaauuagagaauuaaugcucgacuuaccaaacgcaaauauguuaagagaccaccaauuugauacagugcgaucaaaauucuacacauuacuagacuuuauuauuuaccaacauuaucucgaagaaaaaucaagaauagacaacaugguagaaaaauuaagaaugacacugaaagaagaagaaaaagaagugcuauaugccgccgaagcaaaaauaguauggaacgcaauaggagcaaaaguaauaaauaaauuaguuccaaugaugaauggagacgcacuaaaagaaauaaaaaggaaaaacagagacagaaaacuaccccaaagcguaauagcuaccguacaaguaaauucagacgcgaaugucuuuucaggacuuauauacuucuuaaccuuguucuuggacggcaaagaaaucaaugaaaugguaucaaauuuaauaacaaaauucgaaaacauagacucccuauuacacguagauagagaaaucuauaaaucagaugaaaaagaccuugaccuagaaauagaaaaauuagcauuguucuucaaaggagucguaagaccuaacgcaaaaacagacacaggagcaggcgaaauaagcaaauccuuuucaauauuccaaagcgcagaaagaauaaucgaggaauuaaaauuuauuaaaaauguaacuagaauggauaacgaaauauuuccaagugaaggaguauucuuagacgccgcaaacguacuagggguccgcggagaugauuuugauuucaguaaugaguucgugggagacgacuuacacagugacgcuaauaagaaaauaauaaacaaaaucaaugguaccaaagaagaccgaaacuuaaggaacuuuauaauaaauaauguaguaaaaucucgacguuuccaauauaucgcaagacacaugaacacacacuacgucaaacaauuagccaacaaugaaacuuugaaccgauuuguuuuaaauaaaaugggagacgcaaaaauaauaaacagauauuacgaaucaauuaguggaaauacgccaaauaucgaaguacgcucacaaauugauuaccuuguaaaacgauuacgaaguuucagcuucgaagaccuaaacgauguaaaacaaaaaguaagaccaggaaccaacgaaucaauagaaaaagaaaagaagaaagccuuagucggucuaugccucacgauacaauacuuaguuuacaaaaaucuaguaaacauaaacgcaagauauacaacggcauuuuacugucucgaacgagacucaaaacuaaaaggauuuggagucgacguauggcgagauuucgaaucauacacagcauuaacaaaucacuucauaaaagaaggauauuuaccaguaagaaaagcagaaauucuaagagcaaaccuaaaacacuuagacugcgaagacggcuuuaaauauuaugcaaaucaaguuacagcgcucaaugccauucgcguagcauauaaauauauaaaugaaauaaaaucaguacauuccuacuucgcauuauaccacuacauaaugcaacgacaucuauacgacucauuacaggccaaagcgaaagacucaagugguuuuguaaucgacgcccucaaaaagagcuucgaacacaaaauauacucaaaagauuuacuacacguucuacauucgccauucggcuauaacacagcccgcuauaaaaaucuaagcaucgaagcacuuuucgauaaaaaugaaucgagaccugaaguaaaucccuugucaacaaaugacggaagcggacccaaaaagaaacgaaaaguagcggccgcauacccauaugacgucccugacuacgcauga

SEQ ID NO: 14494 - RNA, 2892 nt, Artificial Sequence
  Cas13d variant__Eubacterium siraeum DSM15702__EsCas13d-HA
augggaaagaaaauacacgcacgcgauuugagagaacagcgcaaaaccgauagaacggaaaaauuugcagaucaaaacaagaaaagagaagcagaaagagcaguaccaaagaaagaugcagcaguaaguguaaaaagcgugucaucaguaucaaguaagaaagacaauguuacaaaaucaauggcaaaagccgcaggagugaaaucaguuuucgcuguuggaaauacaguauauaugacuagcuuuggaagaggaaaugacgcaguacuagaacagaaaauuguagacacaagucaugaaccacuaaacaucgacgauccagcauaucaauuaaacguagucacaaugaacggauacagugucacgggacacagaggagaaaccguuucugcuguaacagacaauccucuaagaagauucaacggaagaaagaaagacgaaccagaacaaucaguaccuaccgauauguuaugcuuaaaaccaacacuggaaaagaaauuuuucggaaaagaguucgaugauaacauacacauacaacuuauauauaacauauuagauauagagaaaauccuagccguuuacucaacaaacgcaauauacgcacuaaacaacaugucagcugacgaaaacauugaaaacagugauuucuuuaugaaacgaacaaccgaugaaacauuugacgacuuugagaaaaagaaagaaucaaccaauucuagagaaaaagcagauuuugaugcauucgaaaaauucauugguaauuacagguuagcauacuucgcagaugcauuuuacguaaauaagaaaaauccuaaaggaaaagcuaaaaauguacuacgagaagauaaagaacuauauaguguauuaacuuuaauaggaaaacugagacacuggugcguucacucagaagaagggagagcagaauuuuggcuauacaaauuagaugaacuaaaagacgacuucaaaaauguacucgaugugguauauaauagaccagucgaagaaauaaacaacagguuuauugaaaacaauaaaguaaauauacaaauucucggaagcguauacaaaaauacugauauagcagaauuaguaagaaguuauuaugaguuccuaauaacaaagaaauauaaaaacaugggcuucagcauaaagaaacuacgagaaucaaugcucgaaggaaaagguuacgcagauaaagaauacgauaguguuagaaacaaacuauaccaaaugacagauuuuauauuguacacgggauauauaaacgaagauucggaccgagccgaugaucuaguaaauacacuuagaaguaguuuaaaagaagacgacaaaacaacgguauauugcaaagaagccgauuacuuauggaagaaauacagagaaucaauuagagaaguagcagacgcccuggauggagacaacauaaagaaacugucaaaaagcaauauagaaauucaagaagacaaacuuagaaaaugcuuuauaucauacgccgacucaguaagugaauuuacaaaacuaauauacuugcucacaagauuccuaucgggcaaagaaauuaaugaccuaguaacaacauuaauuaacaaauucgauaauauuaggaguuuccucgaaauaauggacgaacuaggauuagauagaaccuucacagcagaauacagcuuuuucgaaggaucgaccaaauaucuagcagaauuaguagaacucaacuccuuuguaaaaucaugcucauucgacauuaaugcaaaaagaacaauguacagagacgccuuagauauauuaggaauagaaucagauaaaacagaagaagacaucgagaaaaugauagacaauauacuccaaaucgacgccaacggagacaagaaacuaaagaaaaacaacggauuacgaaacuuuauagcaucaaacguaauugacucaaacagauuuaaauacuugguaagauacgguaauccuaagaaaauaagagaaacagcaaaaugcaaaccugcaguacgauucgugcugaaugaaauaccagacgcacaaauagaaagauacuacgaagcauguugccccaaaaacaccgccuuauguuccgcaaauaaaaggagagaaaaauuagccgacaugauagcugaaauaaaauuugaaaacuucagcgaugccggcaacuaccaaaaagcgaacguaacauccagaacaucugaagcagaaauaaaacgcaaaaaucaagcaaucauaagauuauacuuaacuguaauguacauaauguugaaaaaucuaguuaacguaaaugcucgcuaugugauagcuuuccacugcguagaacgagauacaaaacuuuacgcagaaaguggccucgaaguuggaaacauagagaaaaacaaaacaaaucuaacaauggcaguaaugggcguaaaacuagaaaauggaauuauaaaaacggaauuugauaaaucauucgcugaaaacgcagcgaauagguauuuaaggaaugcacgaugguacaaacucauacucgauaaucucaagaaaagugaaagagcagucguaaacgaguuccgaaauacaguaugucaucuaaacgcuauacgcaauauaaacauaaacauaaaagaaauuaaagaagucgaaaauuauuucgcucuguaccacuauuuaauccaaaaacaccuagaaaacagguuugcagacaagaaaguagaaagagacacaggcgauuucauaucaaaauuggaggaacacaaaaccuauugcaaagauuucgucaaagcauauugcacucccuuuggcuauaaccuaguaagauauaaaaaccuaacuaucgacggauuauuugacaaaaacuaccccggcaaagacgauagcgacgaacaaaaguacccauaugaugucccggauuacgcuuga

SEQ ID NO: 14495 - RNA, 2892 nt, Artificial Sequence
  Cas13d variant__Eubacterium siraeum DSM15702__dEsCas13d-HA
augggaaaaaaaauucacgcaagggacuugcgggaacagcgaaagacugacaggacggaaaaauucgcggaccaaaauaaaaaacgcgaagcugaacgagccguacccaaaaaagacgcagcaguaucaguaaaaucaguaucuucaguaucaagcaaaaaagacaacguaacaaaaagcauggccaaagcagcagguguuaaguccguauuugccguaggaaacaccguauacaugacgucguuuggacgaggaaacgacgcaguacuagaacaaaaaauaguagacacgagucacgaaccccuaaacauagaugacccagcuuaucagcuaaacguagugacaaugaaugguuauagcguuaccggacauagaggagaaacaguaucagcuguaaccgacaacccacuucgaagauuuaauggccgaaaaaaagaugaaccagaacaaucaguucccacagauauguuaugcuuaaaaccaaccuuggaaaaaaaguucuuuggcaaggaauucgacgauaacauacauauacaacuaauauauaacaucuuagauauagaaaaaauauuagcaguguacaguacaaaugcaauauacgcguuaaacaacaugagcgcagaugaaaacauagaaaacucagacuucuuuaugaaaagaacaacagacgaaacauuugacgacuucgaaaaaaaaaaagaaaguacaaacucacgagagaaagcagauuucgaugccuucgaaaaauucauaggaaauuacagauuggcauauuucgccgaugcauucuauguaaauaaaaaaaaucccaaaggaaaagcaaaaaacguacuaagggaagacaaagaacuauacaguguauuaacacuaauuggcaaacuagcacauuggugcgucgcaucugaagaaggaagagcagaauuuuggcuauauaagcucgaugaauuaaaagacgauuuuaaaaauguacucgacgucguauacaaucgaccaguagaagaaauuaacaaucguuucaucgaaaacaacaaaguaaacauccaaauauuagguaguguuuacaagaacaccgacauagcugaacucguacgcucauauuacgaauuucuuaucaccaaaaaauauaaaaauaugggauucaguauaaaaaaacuacgugaaucuaugcuugaaggaaaaggauaugcagacaaagaauacgacagcguaagaaauaaacuguaucaaaugacagacuuuauauuauacacaggauauauaaaugaagacucagaucgagccgaugaucuaguaaauacguuaaggaguagucuaaaagaagaugacaaaacaacuguuuacugcaaagaagcagacuaccuauggaaaaaauacagagaaaguauaagagaaguugcugaugcacuugauggagauaauauaaaaaaacuaagcaaaucaaauauagaaauccaagaagacaaacuaagaaaauguuuuauaaguuacgcagacagcguaagcgaauuuacaaaauuaauauacuuacuaacaagauuuuuaagcggcaaagaaauaaacgaucuaguaacaacacuaauuaauaaauucgacaacauaagaucauucuuagagauaauggaugaauuaggauuagauagaacauuuacagcugaauacucauuuuuugaaggaagcacgaaauaccuagcagaacuuguagaacuaaacucuuuugucaaaucguguucauucgauauaaaugcaaaaagaaccauguauagagacgcacuagacauauuaggaaucgaaucagacaaaaccgaggaagacauagagaaaaugaucgacaauaucuuacaaauagacgcaaauggagacaaaaaauuaaaaaaaaauaacggauuacgaaacuucaucgcaucaaauguuaucgacucaaaccgauucaaauaccucgugagauauggaaauccaaaaaagauuagggaaaccgccaaauguaaacccgcuguacgauucguacuaaacgaaauucccgaugcucaaauagaaagauacuacgaagcauguuguccaaaaaauacggcauuauguagcgcuaauaaaagaagggaaaaacuggcagacaugauugcagaaauaaaauucgaaaauuucagcgacgccggcaacuaccaaaaagcaaauguuacgucgagaacuucugaagcugaaauaaagcgcaaaaaucaagcuauaauaagacuauaucuuacaguaauguauauaauguuaaaaaaccuaguaaauguaaacgcccgauaugugauagccuuucacuguguagaaagagauacaaaacuauacgcagaauccggcuuagaaguugguaacauagaaaaaaacaaaacaaaccuaacuauggccguaaugggaguaaaacuggaaaauggaauaauaaaaacagaauucgacaaaucauucgcagaaaacgcagcuaaucgauaucuuaggaaugcuagaugguacaagcuaauacuugauaacuuaaaaaaaagcgaacgagcgguaguaaacgaauuugccaauacaguaugcgcacuaaacgcaauaagaaacauuaauaucaauauaaaagaaauaaaagaaguagaaaacuacuucgcauuguaucacuaucugauacaaaaacaccuagaaaacagauuugccgacaaaaaaguugaaagagacaccggagacuucauaucaaaacuagaagaacacaagacauauugcaaagauuuuguuaaagcauacuguacaccauucgguuacaauuuaguaagauauaagaaccugacaauagauggauuauucgacaaaaauuacccaggaaaagaugacagugacgagcaaaaauaccccuaugacgucccagauuacgccuga

SEQ ID NO: 14496 - RNA, 2964 nt, Artificial Sequence
  Cas13d variant__Eubacterium siraeum DSM15702__NLS-EsCas13d-NLS-HA
augucaccaaaaaaaaagaggaaagucgaagcaucaggaaaaaaaauacacgcacgugaccucagggaacagcgcaaaacggauagaacugaaaaauuugcagaccaaaauaaaaaacgcgaagcggaaagagcaguaccaaaaaaagacgccgcagucucaguaaaaucaguaucaucaguuuccaguaaaaaagacaacguuacuaaaagcauggcaaaagcagccgguguuaaaucaguauuugcaguaggaaauacaguauauaugacaaguuucggacgaggcaaugaugcgguucucgaacaaaaaauuguggauaccucacaugaaccacuaaauauagaugauccagcauaccaauuaaauguaguaaccaugaauggauauucagucacaggccauagaggagaaacaguuagugccguaacugauaaccccuuaagaagauucaacggaagaaaaaaagaugaacccgagcaaucugucccaaccgacaugcucugccuaaagccaacacucgaaaaaaaauucuuuggaaaggaauucgacgacaauauacauauucagcuaaucuacaauauccuagacauagaaaaaauacuagccguuuacucaacuaacgccaucuaugcauuaaauaacaugagcgcggacgaaaacaucgaaaacucagauuucuucaugaaacgaacaacugaugaaacuuuugaugauuuugaaaaaaaaaaagaaaguacuaauagcagagaaaaagcugauuuugaugcauucgaaaaauuuaucggaaauuauaggcucgcauacuuugcugaugcauuuuauguaaauaaaaagaacccaaaaggaaaagcaaaaaacguguugagagaagauaaggaacucuauuccguacugacauuaauaggaaagcuaagacauuggugcguacacucagaagaaggaagagcagaauuuuggcuauauaagcuugacgaauuaaaagaugacuuuaaaaacguacuagacguaguauacaaccgucccguagaagaaauaaacaaucgauucaucgaaaauaacaaagugaacauccaaauacuaggaagcguuuacaaaaacacagacauugcagaacuaguacgcucauacuaugaauuccucauaacaaaaaaauauaaaaacaugggcuuuucgauaaaaaaguuacgagaaucaaugcuagaagguaaaggcuaugccgacaaggaauacgauaguguucgaaacaaacucuaucaaaugacagacuucauauuauauacaggauacauuaacgaagauagcgauagagcagacgacuuaguaaauacauuaagaagcuccuuaaaagaggacgacaaaacaacaguuuauugcaaagaagcagauuaccucuggaaaaaauaucgagaaagcauacgagaagucgccgaugcauuagacggagauaauaucaaaaaauuaaguaaaagcaacauugaaauccaagaagacaaacuaagaaaaugcuucauaagcuaugcagacucgguaucagaauuuacuaagcuaauuuaucugcuaaccagauuuuuaaguggaaaagaaauaaaugaucugguaacaacacugaucaacaaauucgacaauauacgaaguuuuuuagaaauaauggaugaacuaggacuagacagaacauucacagcagaauauucauucuucgaaggaucgacaaaauaucuagcugaacuaguagaacuaaauucauuugugaaaucauguucauucgacauaaacgcaaaacguacaauguauagagacgcucucgacauauuaggcaucgaaucagacaaaacagaagaagacauagaaaaaaugauugacaacauacugcaaauagacgcgaacggugauaaaaaacucaaaaaaaauaacggauuaagaaacuuuauagcaucuaacgucauagacagcaacagauucaaauaccuaguaagauacggaaaccccaaaaaaauaagagaaacugcgaaaugcaaaccagcaguaagauuuguauuaaaugaaaucccggacgcacaaauagaaagauacuacgaggcauguugcccuaaaaacacagcauugugcagugccaauaaaagacgagaaaaacuagcagauaugauagcagaaauaaaauuugagaacuuuagcgacgcaggaaacuaccaaaaagcuaacguaacaucgcguacaagugaagcagaaauaaaaagaaaaaaccaagccaucauccgauuauaucuaacagugauguacauuaugcuaaaaaacuuaguaaauguaaacgcaagauaugucauugccuuucauuguguagaaagagauacuaaacuauaugcagagucaggacuagaagugggaaacauugaaaaaaauaaaacaaaccucacaauggcaguaaugggagucaaacuggagaacgguaucaucaaaacagaauuugauaaaagcuuugcggaaaacgcggcgaauagauaucuacgaaaugcaagaugguacaaauuaauauuagacaacuuaaaaaaaucagaaagagcaguagugaacgaauuucguaacacaguaugucaucuaaaugcaauaagaaacauaaacauaaacauaaaagaaauuaaagaaguagagaacuauuuugccuuauaucauuacuuaauucaaaaacacuuagaaaacagauuugcagacaaaaaaguggaacgagauaccggugacuuuaucaguaaauuagaagaacauaaaacauacuguaaagauuucguaaaagcauauuguacgccauucggguauaaucuaguaagauauaaaaauuuaacaauagacggauuauuugacaagaauuauccagguaaagaugacucagaugaacaaaaaggaucaggaccuaaaaaaaaacgaaaaguugcagcagcauauccauacgauguaccugacuaugcuuga

SEQ ID NO: 14497 - RNA, 2964 nt, Artificial Sequence
  Cas13d variant__Eubacterium siraeum DSM15702__NLS-dEsCas13d-NLS-HA
auguccccaaaaaaaaaaagaaaaguagaggcaagcggaaaaaaaauacacgcaagagaccucagagaacaaagaaaaacugaccgaacagaaaaauuugcugaccaaaauaagaaacgcgaagccgaaagagcgguaccaaaaaaggacgcugcagugucaguaaaaagcgucaguucgguaucaagcaaaaaagacaacguaacaaagaguauggcgaaagcagcgggggucaaaucgguauuugcaguagguaacacaguauacaugacgagcuuuggucgcggcaaugaugcagugcucgaacagaaaauaguagauacaagucacgaaccucuuaauauagacgacccagcuuaucagcuaaauguuguaacuaugaacgguuauucagugacaggucacagaggcgaaacaguaagcgcuguaacugacaacccacuaagacgcuucaauggacgaaaaaaggaugaaccggaacaaucaguccccacagacaugcuaugucugaaaccaacacucgaaaaaaaauuuuucggaaaagaauucgacgauaauauacauauacaauuaauauacaacauacuagacauagagaaaauauuagcaguauauagcacaaaugcaauauaugccuuaaacaacaugucagcagaugaaaauauagaaaacagcgacuucuuuaugaaacgaacaacagaugaaacauuugacgacuucgaaaaaaaaaaagaauccaccaauucaagagaaaaagcggacuucgacgcguucgaaaaauucaucgguaauuacagacuagcauauuucgcagaugcauuuuacguuaacaaaaaaaacccaaagggaaaagccaaaaacgucuuaagagaagauaaagaacuauauuccguacuaacccuuauaggaaaacuagcucauugguguguagccagcgaagaaggaagagcagaauucuggcuauauaaacucgacgaauuaaaagaugauuucaaaaacguucucgacguuguauauaaucgaccaguagaagaaauuaauaauagauuuauagaaaauaacaaggucaauauacaaauacuaggcagcguauauaaaaacacagacaucgcugaacuuguuaggaguuauuaugaauuccuaauuacaaaaaaauauaaaaauaugggauuuagcauaaaaaaauugagagaaucaauguuagaaggcaaaggauacgcagacaaagaauaugacucuguccgaaauaaacucuaucaaaugacugauuucauauuauacaccggauacauaaacgaagauucagaucgggccgaugaucucguaaacacacuacguucaucccucaaagaagaugacaaaacuacaguuuacugcaaagaagcagauuacuuauggaaaaaauacagagaaagcauccgagaaguugcagacgcauuagauggugacaacauaaaaaaacugagcaaaagcaauauagaaauacaagaagauaaauuaagaaagugcuuuauaaguuacgcagacagcgucucagaauuuacaaaacuuauauaucuucucacaagauuccuaucaggcaaagaaaucaacgaccugguuacaacauuaaucaacaaauucgacaacauacgcucauuuuuagaaauuauggacgaauuaggccuagaccgaacauucacagcugaauacagcuuuuucgaaggauccacaaaauaccuagcagaacuaguagaacuaaauucauucguaaaguccuguucauucgacauaaacgcgaaaagaacaauguaucgagacgcacucgacaucuuaggaauagaaucagauaaaaccgaagaagacaucgaaaaaaugauagacaacauuuuacaaaucgaugcaaauggagauaagaaauuaaaaaaaaacaacggcuuacgaaacuuuauagcaagcaacgugauagacagcaauagauuuaaauacuuaguuagauacggaaacccaaaaaaaauaagagaaaccgcaaaauguaaaccugccgugagauucguauuaaaugaaauuccagaugcccaaauagaaagguauuacgaagcaugcugcccaaaaaacacagcgcuaugcucagccaacaaacgaagagaaaaauuagcugauaugauugcagaaauaaaauuugaaaauuucagcgacgcaggaaacuaccaaaaagccaacguaaccagcaggacaucagaagccgagauaaaaagaaaaaaucaagcgauaauaaggcuuuaccucacaguaauguacauuaugcuuaaaaauuuaguaaauguaaaugcccgcuauguaaucgcuuuccacugcguagaacgugacacaaagcuuuacgccgaaagcggacuagaaguuggaaauauagaaaaaaacaaaacaaaucugacuauggcaguuaugggaguaaaacuagaaaauggcauuaucaaaaccgaauucgauaaaucauucgcggaaaacgcagcaaauagauacuuaagaaaugcaagaugguauaaacuaauccuagacaaccuaaaaaaaucugaaagagcagucgucaaugaauucgcaaacacggucugcgcauuaaacgcuauacgaaauauuaauaucaacaucaaagaaauaaaagaaguagagaauuauuuugcauuauaccacuaucuuauacaaaaacaucuagaaaacagauuugcagacaaaaaaguagaaagggacacaggggacuucauaucuaaacucgaagaacacaaaacguauugcaaagacuucguaaaagcuuauuguacuccuuucggauacaaccuagugagauauaaaaaucuaacaauagauggucucuucgauaaaaauuacccaggaaaagacgacagugacgagcaaaaaggaucaggaccaaaaaaaaaaagaaaaguagccgccgccuacccuuaugacgucccagauuacgcauga

SEQ ID NO: 14498 - RNA, 3402 nt, Artificial Sequence
  Cas13d variant__Eubacterium siraeum DSM15702__PspCas13b-NES(HIV)-3xHA
augaacauaccagcgcucguagaaaaccagaaaaaauacuucgggacauauucuguuauggcaauguuaaaugcacaaacuguccuagaucauauccagaagguagcagacauagagggcgaacaaaaugaaaacaacgagaacuuaugguuccacccgguaaugagucaucuauacaaugcaaaaaacggauacgacaaacaaccugaaaaaacgauguucaucauugagagacuacaaucauacuuccccuuccuaaaaauaauggcugaaaaccaaagagaguacucuaaugguaaauauaaacaaaauagaguugaaguaaacucaaacgacauauucgaagugcuaaaaagagcauucggaguccugaaaauguacagagaucuuacaaaccacuauaaaacauacgaagaaaaacuaaacgacgguugugaauucuuaacaucaacagaacaaccguugagcggaaugauaaacaauuacuauacaguagccuuacgaaacaugaacgagagguacggauacaaaacggaagauuuagcauuuauccaagacaaaagguuuaaauucgugaaagaugcauacgguaaaaaaaaaagucagguuaauacaggguuuuuucucucacugcaagauuauaauggugacacacaaaaaaaauuacaucuuucaggagucggaauagcacuguuaauaugccuuuuccuggauaaacaauauauaaauauauuucucaguaggcuacccauuuucagcucauacaaugcacagucggaagaaagacgcauaauuauuagaaguuuuggcauaaauuccauaaaacuaccgaaggauagaauacacucagaaaaaucaaacaaaucuguagcaauggacaugcuaaacgaaguaaaaagguguccagaugaauuguucacaacacuuucagcagaaaaacaaucaagguucagaaucauaagugacgaucauaaugaaguucuuaugaaaagauccagcgacagauucguaccccuccugcuacaauauauagauuacggaaaacuguuugaucacauccgguuccauguuaauaugggaaaauuacgcuauuuacuaaaagcagauaaaacauguaucgacggacaaacaaggguacgcguaauagaacaaccauugaacggauuuggacgauuagaagaagcagaaacuaugaggaaacaagaaaacggaacuuuugguaacucaggcauccguauuagagauuuugaaaacaugaaaagggacgaugcaaacccagccaacuauccuuauauaguagauacauauacucacuacaucuuagaaaauaauaaaguugaaauguucauuaaugacaaagaggacucagcccccuuauuacccguaauagaagacgacagauacguaguaaaaacaauuccaucaugccgcaugaguacucuagaaaucccagcaauggcuuuucauauguuuuuauuuggaaguaagaaaacugaaaaauuaauagucgacguacacaacagguacaaaagacuauuccaggcaaugcaaaaagaggaaguaacugcagaaaauauagcuaguuucggaauugccgaaucagacuuaccccaaaaaauauuagacuuaauuucaggaaacgcacacggcaaagacguagaugcuuucauucgucuaacagucgaugacauguuaacagacacugaaagaagaauaaaaagauucaaagacgaccguaaaaguauacgcagcgcagacaauaaaaugggaaaaagaggcuuuaaacaaauuagcacagguaaacucgcagacuuccuagcuaaagacauaguucuauuccaaccaucagucaaugauggagaaaauaaaaucacagguuuaaacuaccgaauaaugcaaagcgcaauagcaguauaugauucaggagacgauuacgaagcaaaacaacaauuuaaacuuauguucgaaaaagcacgacugauaggaaaaggaacgacagaaccacacccauuucucuacaaagucuuugcucggaguauacccgccaacgcaguagaauuuuacgaacgauauuuaauagaaagaaaauucuacuuaacaggacuaucuaaugaaauaaaaaaagguaauagaguagauguacccuucauuagaagagaccaaaacaaauggaaaacgccagcgaugaaaacacuaggcaggaucuacagugaagaccuuccugucgaauuaccaagacaaauguuugauaaugagauaaaaucacauuuaaaaucucuuccccaaauggaaggaauagauuucaacaaugcaaacguuacuuaccuaauugcagaguacaugaaaagaguauuagaugaugacuuucaaacuuuuuaccaauggaauagaaauuacagguacauggacauguuaaaaggcgaauaugacagaaaggguucacuacaacacugcuuuaccucuguagaagaacgugaaggccucuggaaagaacgugcaucacgaaccgaaagauacagaaaacaagcgagcaacaaaaucagaagcaaccgacaaaugagaaacgcaucgagcgaagaaauugaaacaauauuagacaagcgauuaagcaauagccgaaaugaauaucaaaaaucugaaaaagucauaagaagauauaggguacaagacgcacuccuauuucucuuagcuaaaaagacacuaacagagcuagcagacuucgauggagaacgauucaaauuaaaagaaauuaugccggacgcagaaaaaggaauacuaucagaaauaaugccgauguccuucacuuucgagaaaggaggaaaaaaauacacaaucaccagcgagggaaugaaacuaaaaaacuacggugacuucuucguauuagcaagugauaaaagaauaggcaaccuauuggaauuaguagguucagacauaguaucaaaagaagacaucauggaagaauucaauaaauacgaucaaugcagaccugaaaucaguagcauaguuuuuaacuuagaaaaaugggcauucgacacguacccagaacuaucagcaagaguugacagagaagaaaaagucgauuuuaaaucaauauuaaaaauacuauuaaacaacaaaaacauaaacaaagaacaaagcgacauuuuaaggaaaaucagaaaugcauucgaucauaauaauuacccugacaaaggagucguugaaauaaaagcauuaccggaaauugcaaugucuauaaaaaaagcguucggggaauaugccauuaugaaaggaagccuacaacuuccaccacuagaaagacuuacauuaggauccucguauccguacgauguaccagacuaugcuuacccuuacgacguaccagacuacgcauauccguaugacguaccagauuacgcguga

SEQ ID NO: 14499 - RNA, 2748 nt, Artificial Sequence
  Cas13d variant__Gut metagenome assembly P1E0-k21__P1E0Cas13d-HA
auggaaagggaaguaaaaaaacccccaaaaaaaagucuagccaaagcugcuggacuaaaaagcaccuucgucauauccccacaagagaaagaauuagccaugacagcauucggaagggguaacgaugcuuuacuacaaaaaagaauaguagacggaguuguacgagauguagccggagagaaacaacaauuucaaguacaacgucaagaugaaucaagauuuagauuacaaaacaguagauuagccgaucgcacaguaacagcagaugacccauuacacagagccgaaaccccaagacgacaaccgcuuggagcaggaauggaccaauuaagaaggaaagcuauauuagaacaaaaauacuuugggagaacuuucgaugauaacauucauauucaacucauauauaacauauuagauauacacaaaauguuagcaguaccggcaaaucauauaguacacacuuugaauuuacuuggaggauauggagaaacggauuuugucgguaugcuuccugcuggacuacccuaugacaaauugagaguugucaaaaaaaaaaacggagacaccguagacauaaaggcagauauugcugcuuacgcaaaaaggccacaacucgcauauuuaggggcugcauuuuacgacguaacuccuggaaaaaguaaaagggacgccgcacgagguagaguuaaaagagagcaagauguauaugcgaucuuaucacuaaugucuuugcuccgacaauuuugcgcccaugauaguguaagaauuuggggucaaaauacaacagccgcacuguaccacuuacaagcguugccacaagauaugaaagaucuucucgacgacgguuggcguagagcauuaggagguguaaaugaucauuuccuagauacuaacaaaguaaaccuacuaacauuauuugaauauuacggugcagaaacuaaacaggcuagaguugcacugacacaagauuuuuaucgauucguaguucuaaaagaacaaaaaaacaugggauucaguuuaagaagacucagggaagaauuauuaaaauuaccagaugccgcuuacuugacaggucaagaguaugauucagugagacagaaauuauacauguuauuggacuuuuuauuaugccgacuuuacgcacaagaaagagccgaucgaugcgaagaauuaguuagugcccuuagaugugcuuuaucagacgaagaaaaagacacagucuaucaagcagaagcagccgcauuauggcaagcauuaggggacacacuacgaagaaaacuccuaccccuuuuaaaaggcaaaaagcuacaagacaaggauaaaaaaaaaucagacgaacuaggccuaucaagagacguacuggauggaguucuauuuagaccugcccaacaggguucccgugcaaacgcagacuacuucugcagauuaaugcaucuaucaacaugguuuauggauggaaaagaaauaaauacacuacuaacuacacucaucucaaaauuagaaaacauagacaguuuacguucgguguuagaaucaaugggauuagcauauucauuuguuccugcuuacgccauguucgaucacucaagauauauagcaggacaauuacgaguuguaaacaacauagcccguaugagaaaaccagcaauaggagccaaacgcgaaauguauagagcagcaguuguacuauuaggaguugauaguccagaagcagccgcagcuauuacagacgacuuacuacaaauugauccagaaaccggcaaagugagacccaggagugacucagcacgagauacaggacuucggaacuuuauagcaaauaaugucguagaaucacgaagauucacguauuuauuaagauauaugacaccggaacaagcaagaguauuggcccaaaaugaaaaacucauagcauuuguauuaucaacaguuccagacacacaauuagaacgauauugcagaacuugugguagggaagauauuacuggaagaccggcacaaauaagauaccuuacagcacaaauaaugggaguacgauacgaauccuucacagacguggaacaaagaggaaggggagauaacccaaaaaaagaaagauacaaagcucuaauaggcuuguacuuaacaguacuuuaucuugcaguaaaaaauaugguaaacuguaacgcaagauauguaauugccuucuauugcagagaucgagacacggccuuauaucaaaaagaaguaugcugguaugauuuagaagaagacaaaaaaucaggaaaacaacgacaaguagaagauuacacagcccuaacaagguacuucguuucgcagggauaccucaacaggcacgcaugcggauaccuuagaaguaauaugaacggaauaucaaauagccuuuuaacugcauauagaaaugcaguagaucaucuaaacgcaauuccaccauuaggaucacuaugccgcgauauaggacgaguagacucauacuuugcuuuauaccacuaugcaguacaacaauauuuaaauggacgauauuaccgaaaaacaccaagagaacaagaguuauucgcagcaauggcucaacauagaacgugguguucagaucuaguaaaagcuuuaaacacaccuuuuggauauaaucuagcuagauauaaaaaucuaucaauagacggacuuuuugauagagaaggagaucacgucguuagagaagauggugagaaaccugcagaauauccuuaugauguaccugauuaugcauga

SEQ ID NO: 14500 - RNA, 2748 nt, Artificial Sequence
  Cas13d variant__Gut metagenome assembly P1E0-k21__dP1E0Cas13d-HA
auggaacgcgaaguaaaaaaacccccaaaaaaaucauuagccaaagcggccggacuuaaaucaacauuuguaauaucaccccaagaaaaagagcuugcaaugacugcauucggaagagggaaugaugcucuuuuacaaaaacguauaguagacggaguuguccgagauguagccggugaaaaacaacaguuucaaguacaaagacaagaugaaucacguuucagauugcaaaacucacgacuugcagauagaacaguaacugcagaugauccccuccauagagcugaaacaccaagaagacaaccacuaggggcagggauggaucaacuuagaagaaaagccauucuugaacaaaaguauuuuggaagaacuuucgaugauaacauccacauacagcuuauuuauaauauauuagacauacacaaaaugcuggcgguuccugcaaaccauauaguacauacccuaaacuuauuagguggauacggugaaacagauuuuguuggaaugcucccagcaggucugccauaugauaaacuccgcguaguuaaaaaaaaaaauggugauacaguagauauaaaagcagauauagcagcuuacgcuaaaagaccccaacuagcauaucucggagcggcauuuuacgacgucacuccagggaaaucaaaaagagacgcugcgagaggaagagucaaacgcgaacaagauguuuacgcaauauuauccuugaugaguuuacuagcccaauuuugugcagcagauucaguuagaauauggggacaaaauacgacagcagccuuauaucaccuacaagcucuaccucaagauaugaaagaccuucuagaugacggauggagacgagcauuaggagguguaaaugaucauuuuuuagauacaaauaaaguaaauuugcuuacacuauucgaauauuauggagcagaaacaaaacaagcuagaguagcgcuuacucaagauuuuuauagauucgugguauuaaaagaacaaaaaaauaugggauuuucacuaagaagacuaagagaagaacuacuaaaauugccagaugcggcauacuuaacaggucaggaauaugauuccguaagacaaaaauuauauaugcuccuagacuuccuacuuuguagacuauaugcccaagaaagagcagauaggugugaagaauuaguaagugcacuaagaugugcauuaucagaugaggaaaaagacacaguauaccaagcagaggcggcagcacuauggcaagccuuaggugacacacucagaagaaaauuauuaccccuccuaaaaggaaaaaaacuacaagauaaagacaaaaaaaaaucagaugaguugggacuaagccgugauguuuuagacgguguacuuuuuaggccagcacaacagggauccagagcaaacgccgauuacuuuugucgauuaaugcacuuaucaacaugguuuauggauggcaaagaaauaaauacacuacucacaaccuuaauaucaaaacuagaaaacauagauagccucaggucuguccuggaaaguauggguuuagcuuacagcuuugugccugcauacgcaauguuugaccauucuagauacauagcaggucaacuuagaguaguaaacaacauagcaagaaugagaaaaccagcuaucggugccaaaagagaaauguauagagcagcaguaguacuucuaggugucgacaguccagaagcugcagcagcaauaacagaugacuuauuacaaauagaucccgagacaggcaaagugcguccuagaagugauagugcgcgugauacuggauuaagaaacuuuauugcuaacaaugucguagaaagccgacgauuuacauaucuuuuaagauacaugaccccagaacaagcuagaguauuagcucaaaacgaaaaacuaauagcauuuguucucucgacaguacccgauacacaacucgaacguuacugucgaacuugcggaagagaagauauuacagguaggccugcacaaauacgcuauuuaacugcccaaauaaugggcguaagauacgaaucuuuuacagauguugaacaaagaggaagaggagacaaucccaaaaaagaacgauauaaagcacuaauaggcuuauauuuaacaguuuuauauuuagcugugaaaaacaugguuaauugcaacgcacgauacguuaucgccuucuauugcagagauagagacacagcauuauaucaaaaagaaguauguugguaugaccuagaggaagauaaaaaaagugguaaacaaagacaaguagaagauuauacugcauuaaccagguauuuuguaucacaagguuaucuaaaucgacaugcguguggauacuuacgaaguaauaugaauggaauaucaaacucguuacuaacagcuuaugcaaacgcuguagaugccuuaaaugcaauaccaccauuaggaucacuuuguagggauauaggaagaguugacucguacuuugcacuauaccauuaugcaguacaacaauaccuaaauggacgauauuauagaaaaacaccaagggaacaagaauuauuugcagcaauggcacaacaccguacuuggugcucagaucucgucaaggcauuaaauacaccauuuggguacaaccucgcuagauacaagaacuuaucaauagauggcuuauuugaccgagaaggugaccacguaguucgagaagauggugaaaaacccgcugaauauccauacgacgucccagauuacgcauga

SEQ ID NO: 14501 - RNA, 2820 nt, Artificial Sequence
  Cas13d variant__Gut metagenome assembly P1E0-k21__NLS-P1E0Cas13d-NLS-HA
augaguccaaaaaaaaaacgaaagguagaagcaucagaaagagaaguaaaaaaaccgccgaaaaaaucacucgcuaaagcagcagguuuaaaaagcacuuuuguuauauccccccaagaaaaagaacuagcuaugacagcguucggacgcggaaaugaugcacuacuacaaaaaagaaucguugauggcgucguuagagauguagcaggugaaaaacaacaauuucaaguccaacgacaagacgaaucuagauuuagacuacaaaauaguagauuagcagaucgaaccguaacggcagacgaccccuugcauagagcugaaacaccacgaaggcaaccauuaggcgcuggaauggaucaauuacguaggaaagcaauacuagaacaaaaauacuuuggacgaacguuugaugauaacauacauauacaauuaauauauaauauauuagacauucacaaaauguuagcaguaccagcuaaucauauaguacauacacuaaauuuacuaggaggauacggugaaaccgauuuuguuggaauguuaccagcaggcuuaccuuacgauaaacuaagaguagugaaaaaaaaaaacggagauacuguagacauaaaagcagacauagcugcguacgcgaaaaggccgcaacuagcauaucuuggcgcugcauuuuacgaugucacuccgggaaaaucuaaacgcgaugcagccagagguagaguaaaacgagaacaagacguuuaugcaauacuaucacuaaugagccuacugagacaauuuugugcacaugauucaguaagaauauggggacaaaauacuacagcagccuuauaccauuugcaagcacuaccccaagacaugaaagaucuacucgaugacgguuggcggagagcacuagggggcguaaaugaccauuuccucgauacaaauaaaguaaaucuuuuaacauuguuugaauauuauggagccgaaacuaaacaagcaagaguagcauugacucaagauuucuauagauucgucguccuaaaagagcaaaaaaacaugggcuuuagccuaagaagacuaagagaagaacuacuuaaacuaccagacgcagcuuaucuuaccggucaagaauaugauucaguacgacaaaaauuauauaugcuuuuagauuucuuacuguguagacuuuaugcccaagaaagagcagacaggugcgaagaauuaguaucugcacugaggugugcccuauccgacgaagaaaaagacacgguauaucaagcagaagcagcugcucuauggcaagcauuaggugacacacuuagaagaaaacuauuaccccuacugaaaggaaaaaaacuacaagauaaagauaaaaaaaaaucagacgaauuaggauuaagccgagacguacuagaugguguucuauucagaccagcacaacaaggaucaagagcaaacgcagauuauuuuugcagacuuaugcacuuaucaacaugguuuauggauggaaaagaaaucaauacauuacucacuacacuaauaucaaaauuagaaaacauugacaguuuacguucuguucuagaaagcaugggacucgcauauagcuucguuccggcauacgcaauguuugaccacagccgauauaucgcagggcaacuuagaguaguuaacaacauagcaagaaugagaaaaccagcuauaggagcaaaaagagaaauguauagggcagcuguuguccuucuaggaguagauaguccugaggcagcagcagcaauuacagacgacuugcuacaaauagacccagagacaggcaaaguaaggccacgcagcgauagcgcaagagauacaggccuaaggaauuuuauugcaaacaacguaguagaaucaagaagauuuacuuaucuccuucgauacaugacaccagaacaagcacguguacuugcucaaaaugaaaaauugaucgcuuuuguuuuauccacaguaccagauacccaauuagaacgcuacugcagaacuuguggaagggaagacauaacagguagaccagcacaaauuagauauuuaacagcucaaauaauggggguacguuaugaaucauuuacggauguagaacagagagggagaggggacaauccuaaaaaagaaagguacaaagcauugauagggcuuuaucuaacaguacuauauuuagcuguuaagaacauggucaauuguaaugcacgauacguaaucgcauucuauugccgagacagagacacagcacuguaucaaaaagaaguuugcugguacgaucuagaagaagacaaaaaaagcggaaagcaaagacaaguugaagauuacaccgcacuaacaagauacuucguuagucaaggauauuuaaacagacaugcauguggcuauuugagaucaaacaugaauggcaucaguaauagccuucuuacagcauacagaaacgccgucgaucauuuaaaugcaauaccgccacuaggaucacuauguagagacauaggacggguagauucguauuucgcacuauaucacuaugcagugcaacaauaucuaaauggaagauauuaucgaaaaacaccacgcgaacaagaauuauuugcggcaauggcccaacacagaacgugguguucagaucuuguaaaagcgcucaauacaccuuuuggauauaauuuagcaagauacaaaaauuuaucaauagacggacuauucgacagagaaggagaucacguaguuagagaagauggcgaaaaacccgccgaagggucagguccaaaaaaaaaaagaaaaguagcagcagcuuacccauaugauguuccagacuaugcauga

SEQ ID NO: 14502 - RNA, 2820 nt, Artificial Sequence
  Cas13d variant__Gut metagenome assembly P1E0-k21__NLS-dP1E0Cas13d-NLS-HA
augaguccaaagaaaaaacgaaaaguagaagcaucugaacgagaagucaaaaaaccaccuaaaaaaucuuuagccaaagcagcuggauugaaaagcacuuucguuauauccccacaggaaaaggaacucgcaaugacagccuucgggagaggaaaugacgcacuuuuacaaaaaagaauaguagacggaguaguaagggacguugcaggugaaaaacaacaauuccaaguacaaagacaggacgagucacgauuccgauuacaaaauucacgauuagcugaccgaacaguaacugcugacgacccccuccauagagcagaaacgccucguaggcaaccauuaggagcaggaauggaucaauuaagaaggaaagcaauucuugaacaaaaauacuucggacguacguucgaugauaauauacauauacaacuaauauacaauauuuuagauauucauaaaauguuagcagucccugcuaaccauauaguucacacucuuaaucuacuagguggauauggugaaacagauuuuguagguauguuaccagcaggauuaccauaugauaaauuaagaguuguuaaaaaaaaaaauggugauacaguagauauaaaagcagauauagcagcauacgcaaagcgaccucaacuagcuuauuuaggagcagcuuuuuacgauguuacgccagggaaaagcaaacgagacgcagcaagggggcgaguaaaacgagaacaagacguauacgcgauccuaucacuuaugucgcuuuuagcacaauuuugcgccgcagauagcguuagaauauggggucaaaacacaacagcagcacuauaucacuuacaggcacuaccacaagauaugaaagauuugcuugaugacggauggcggcgagcccuugguggggugaacgaccacuuucuugauacaaauaaaguuaaucuacuaacucuauuugaauacuauggagcggaaacaaaacaagcaagaguugcuuuaacacaagauuucuauagauucguaguccuuaaagagcaaaagaauaugggauucucguuaagaagguuacgagaagaacuauuaaaacuuccugaugcugcauaccuaacuggacaagaauaugacaguguccgucaaaaauuguacaugcuacucgauuuuuuacuaugcagacuguaugcccaagaaagggcagauagaugugaagaauuaguaagcgcguuaagaugcgcacucucagacgaagaaaaagauaccguauaccaagcagaagccgcagcucucuggcaagcuuuaggagauacacuuagacgaaaauuacuaccucuauuaaaaggaaaaaaauuacaagauaaagacaaaaaaaaaucugaugaacugggccuuucaagagacguccuagauggaguuuuguuucgcccagcacaacagggaucuagagcaaacgccgauuauuuuugucgacuaaugcauuuaucaacaugguucauggacggaaaagaaauaaauacauugcuuacaacauuaauuagcaaacuagagaauauagauaguuuaagaucuguacuagaaagcaugggacucgcauacaguuucguaccagcauaugcuauguucgaucauucuagauauauagcuggccaacuacgaguagucaauaauauugcuagaaugcgaaaaccagcaauaggagccaaaagagaaauguacagagcagcaguaguauuauuaggcguagauucccccgaagcagcggccgcaaucacagaugacuugcuacaaauagacccagaaacgggaaaaguacggccaagaagugacucagcacgugauacaggacuaagaaauuuuauugcaaacaauguaguagaaucaagaagauucacuuauuuguuacgauauaugacaccugaacaagccaggguauuagcucaaaacgaaaaacuaauagccuuuguauugucuaccguaccagauacacaauuagagagauacugucguacauguggaagagaagauauuacuggacgacccgcccaaauaagauaccuaacagcacaaauuaugggcguacgauacgaaucauuuacagacguagaacaacggggaagaggggauaaccccaaaaaagaacgauauaaagcccuaauuggacuauauuuaacaguucuauauuuagcagucaaaaauaugguaaauuguaaugcgagauacgucauagccuuuuacuguagagaucgagauacugcucuuuaccaaaaagaaguuugcugguacgaucucgaagaagauaaaaaaucaggaaaacaaaggcaaguagaagauuacaccgcacuaacaagguauuuugucucucaagguuaccuaaauagacaugcuugcgguuaccuccgaaguaacaugaauggaauaucaaacagccugcuaacagcuuacgcgaacgccguagaugcacucaacgcaauaccaccauuaggaaguuuaugucgagauauaggacgaguagauucuuacuucgcccuauaucacuaugcgguacaacaauaucucaaugggagauauuauagaaaaacacccagagaacaagaacuauuugcagcaauggcacaacacagaacaugguguucagacuuaguaaaagcacuaaacacaccauucggcuauaacuuagcaagauauaaaaaucuauccauagauggauuauuugauagagaaggagaccacguuguaagagaagauggagaaaaacccgcugaagguuccgguccaaaaaaaaaaagaaaaguagcagcagcuuauccauaugauguuccagacuacgcauga

SEQ ID NO: 14503 - RNA, 2862 nt, Artificial Sequence
  Cas13d variant__Ruminococcus albus __RaCas13d-HA
auggcaaagaaaucaaaagguaugagucuacgagaaaagagagaauuagaaaaacaaaagagaauacaaaaagcagccguuaacaguguaaacgacacccccgaaaagacagaagaagcaaacguaguaucuguuaacguuaggacuuccgcagaaaauaaacacaguaagaaaucugcugcaaaagcauuaggacuaaaaagcggccuaguaauaggagacgaacuauacuuaacaucauuuggaagaggaaaugaagcuaaacuagaaaagaaaauaucaggcgauacuguggaaaaacuuggaauaggcgcauucgaaguagcugaaagagacgaaucaacacuaacacuagaaagcggacgaauaaaagacaaaacagccagaccaaaagacccacgacacauaaccguagacacccaaggaaaauucaaagaagacaugcuaggcauacgaucuguauuagaaaagaaaauauucggcaaaacauucgaugacaacauucacguacaacuagcauauaacauacuugacguugagaaaauuauggcccaauauguuucagacauaguauacauguuacacaacacagacaaaacagaaagaaaugacaaucucaugggauacaugucuaucagaaacaccuacaaaacauucugcgacacaucaaaccucccugaugacacaaaacaaaaaguagaaaaucaaaaacgagaauuugacaaaaucauaaaaucaggaagacugggauacuucggagaagcauucaugguaaauucuggcaauucaacaaaacuaagaccagaaaaagaaaucuaucacauauucgcuuuaauggcuucacucagacaaucuuacuuccacgguuauguuaaagauacagauuaccaaggcacgaccugggcauauacacuagaagauaaacuaaaaggccccucucaugaguucagagaaaccauagacaaaauauuugacgaaggauuuucaaaaaucucaaaagauuucggaaaaaugaauaaaguaaaucuacaaauacuagaacaaaugauaggcgaauuauacgguucaaucgaaagacaaaaccuaaccugcgacuacuaugauuucauccaauuaaagaaacauaaauaccuaggauucucaauuaaaagauuacgcgaaaccaugcuagaaacaacaccagcggaauguuacaaagcugaaugcuacaauucagaacgucaaaaauuguauaaauuaauagacuuucuaauauacgaccuauauuacaaccgcaaaccagcccgcauagaagaaauuguagacaaauugagagaaaguguuaacgacgaagaaaaagaaaguauuuacucaguugaagcuaaauacgucuacgagagcuuaagcaaaguccuagacaaaagccucaaaaacagcguaucuggugaaacaauaaaagaucuucaaaaacgauacgacgaugaaacagccaaccguauaugggacauuucacaacacaguaucucaggaaacgucaauuguuuuuguaaacucauauacauaaugacuuuaaugcuagacgggaaagaaauuaaugauuuacuaacaacguuaguaaacaaauucgacaauauagcgucauucauagauguaauggaugaacucgggcuagaacacagcuuuacagacaacuauaaaauguuugcagauuccaaagcaauaugcuuggacuuacaauucaucaacucauuugcacgaaugucaaaaauagacgaugaaaaaucuaaaagacaauuauucagagaugcacuuguuauauuagacauaggaaauaaagacgaaacauggauuaacaacuacuuagauuccgauauauucaaauuagauaaagaaggaaauaaauuaaaaggagcaagacaugacuucagaaauuuuaucgcaaacaacguuaucaaguccucgcgcuucaaauacuuagucaaauauuccagugcagacggaaugaucaaacuaaaaacaaacgaaaaacucauaggauucguauuagacaaacuaccugaaacacaaauagaccgauacuacgaauccugcggcuuggacaacgcaguaguagauaagaaaguuagaauagaaaaauuauccggacuaauaagagauaugaaauucgacgacuucagcggaguaaaaacaucaaacaaagcuggagauaacgauaaacaagacaaagccaaauaccaagcuauaaucucauuauaucuaaugguacuauaucaaauagugaaaaauaugauauauguaaacuccagauaugucauagcauuccacugucucgaaagagauuucgguauguauggaaaagacuucgggaaauacuaccaaggaugccgaaaacuaacagaucacuuuauagaagaaaaauauaugaaagaaggaaaacuaggaugcaacaagaaaguaggcagauaucucaaaaacaacauaaguuguugcacagacggccuaauaaacacauauagaaaucaaguagaucauuucgcagucguaagaaaaauagguaauuaugcagcauauauuaaaucaauaggaucuugguucgaauuauaccacuaugucauacaacggauuguauucgacgaauaccgcuucgcguugaauaauacagaaagcaauuauaaaaacucaaucauaaaacaccauaccuacugcaaagauaugguaaaagcacucaauacaccauucggguaugaccuaccaagauauaaaaaucugucuauaggagaccuuuuugaccgaaacaacuaccucaacaaaacaaaagaaucaauagacgcaaacucaucaauagauucgcaauaccccuacgacgugccagauuacgcauga

SEQ ID NO: 14504 - RNA, 2934 nt, Artificial Sequence
  Cas13d variant__Ruminococcus albus __NLS-RaCas13d-NLS-HA
augagcccaaaaaaaaaaagaaaaguagaagcuuccgcuaaaaaaucgaaaggaaugucgcuucgagaaaagagagaacuagaaaaacaaaaacguauccaaaaagcggcagucaacaguguuaacgacacacccgaaaaaacggaagaagcaaacguaguaagcgucaauguaagaacaagcgcagaaaauaagcauuccaaaaagagcgcagcaaaagccuugggacuaaaaucaggcuuaguaauuggagaugaauuauauuuaacaagcuucggaagagguaaugaagcaaaacuagaaaaaaaaauaagcggagacacaguagaaaaauuaggaauaggugcauuugaagucgcugagagagacgaauccacgcucacacuugaaaguggaagaauaaaagacaaaacagcacgacccaaggauccacggcauauaacaguagauacacaagguaaauucaaagaagacauguuaggaauuagaucaguacuugaaaagaaaauauuuggaaaaacauuugaugacaauauacauguacaauuggcauauaauauccuagacgucgaaaaaauaauggcccaauacguaucagacaucguauauaugcuacauaacacugacaaaacagaacgaaacgacaaccuaaugggcuauauguccauaagaaauacauauaaaacuuuuugcgauacauccaaucuuccagacgacacaaaacaaaaggucgaaaaucaaaaaagagaauucgauaaaauuauaaagucaggaagauuagguuauuucggagaagcauucaugguaaacagcgggaacuccacaaaauuacgaccagaaaaagagauauaucacauauuugcacuuauggcaucauuaagacaauccuauuuccaugguuacgucaaagacacugacuaucaaggcacaacaugggcauauacacuagaagacaaacuaaaagguccaucacacgaauuuagagaaaccauagacaaaauuuucgaugaagguuucucaaaaauaagcaaagacuuuggaaaaaugaauaaaguuaauuuacaaaucuuggaacaaaugauaggagaacuauacggcucaaucgaacgacaaaaucucacaugcgacuacuacgauuuuauacagcuaaaaaaacacaaauaccucgguuucagcaucaaaagacuaagagaaacuaugcuagaaacaacaccagcggaaugcuacaaggccgaaugcuacaauagcgaaagacaaaaacuauauaaacuaauugauuuucucaucuaugacuuauauuacaaccgaaaaccagcucggauugaagaaauuguagacaaacuaagagaaaguguuaaugaugaagaaaaagaaucaauauacaguguagaagcgaaauacgucuaugaaagccuaagcaaaguacuugacaaaucacuaaaaaacaguguaagcggugaaacaaucaaagacuugcaaaaaagauacgacgaugaaacagcaaacagaauaugggacauuagccaacauucaaucucaggaaacguaaacugcuuuugcaaacuaauuuauauaaugacucuuaugcuagauggaaaagaaauuaaugaccuucucacaacacuuguaaauaaauuugacaauauagcuagcuuuauagacguaauggacgaauuaggacuagaacacaguuucacugacaacuauaaaauguuugcagacucaaaagcaaucugucuugauuuacaauucauaaauagcuucgcuagaaugaguaaaauagacgaugaaaaaaguaaaagacaacuauuccgcgacgcacuagucauauuagacaucggaaacaaagaugaaacauggauaaacaacuaucuagacucagacauuuuuaaguuagacaaagaagguaauaaacucaaaggagcacgacaugacuuuagaaacuucauagcaaacaacguaauaaaaaguuccagauuuaaauaccuagugaaauacuccagugcugaugguaugaucaaacucaagacaaaugaaaaauuaauaggauuuguccucgacaaauuaccagaaacacaaauagaccgauacuaugaaucuugcggcuuagacaaugccgucguugacaaaaaaguuagaaucgaaaaauugagcggguuaauaagagacaugaaauucgacgauuucucuggaguaaaaaccucaaacaaagcaggagacaacgacaaacaagacaaagcaaaauaccaagcaauaauaucacuuuauuuaaugguauuauaccaaauaguuaaaaacaugauauacgugaauucccgauacgucauagccuuccauugcuuagaaagagacuucggcauguaugggaaagacuuuggaaaauacuaccaaggaugccgaaaauugacugaucauuucauagaagaaaaauacaugaaagaaggaaaauuaggauguaacaaaaaaguaggucgcuaccuaaaaaacaacauaagcuguugcacugauggauuaauaaacacauaccgaaaucaaguagaccacuucgcaguaguaaggaagauaggaaauuaugcagcauacaucaaaucaauaggaagcugguucgaguuauaucacuaugucauacaaagaaucguauuugaugaauauagauuugcacuaaauaacacagaaagcaauuauaaaaacucgauaauaaaacaucacacauauugcaaagauaugguuaaagcacuaaauacuccauucgguuacgaucugccacgauauaaaaaccuaagcauaggggaucuauucgacagaaacaacuauuuaaacaaaaccaaagaaucaauugacgcuaauagcagcaucgacucacaaggcucaggaccuaagaaaaaacgaaagguagcagcugccuaucccuacgauguaccagacuacgcauga

SEQ ID NO: 14505 - RNA, 2829 nt, Artificial Sequence
  Cas13d variant__Ruminococcus flavefaciens FD1__RffCas13d-HA
augaaaaaaaaaaugaguuuaagagagaaacgugaagcagaaaaacaagcaaaaaaagcugcauauuccgccgcaucaaaaaacacggacagcaaaccagcugaaaaaaaagcagaaacaccuaaacccgcagaaauaauaucagauaauucaagaaacaaaaccgcaguaaaagcagcagguuuaaagucaacuauaauaucaggagacaaacuauacaugacauccuuuggaaaagguaaugccgcaguuauugaacaaaaaauagacauuaacgauuacucauuuucagccaugaaagacacaccaucccuagaaguagacaaagccgaaaguaaagaaauaucauuuuccucacaucauccauuugucaaaaaugacaaacuaaccacuuacaauccacucuaugguggaaaagauaauccagagaaaccaguuggacgcgacaugcugggucuuaaagacaaacuagaagagagauacuucggaugcacauuuaacgacaacuuacauauacaaauaaucuacaacauucuagacauagaaaagauauuagccguacacucagcaaauaucacaacagcauuagaccauaugguagacgaagacgacgaaaaauauuuaaacagcgacuacauaggauacaugaauacaauuaauacauacgauguuuucauggaucccucaaaaaauagcucacuaagcccaaaagacagaaaaaacauagauaacucucgagcaaaauuugagaaauuauuaucaacaaaacgacuagguuauuucggauucgacuacgaugccaauggaaaagauaaaaaaaaaaacgaggaaaucaaaaaacgucuauaccaccuaacggcauucgcaggacaacuucgccaauggagcuuucauagcgcaggaaacuacccacgcacaugguuauacaaauuagacagcuuagauaaggaauacuuagacacacucgaccacuauuuugacaaaagauucaacgauauaaacgaugacuuuguaacaaaaaaugcuacaaaccucuacauuuuaaaagaaguauucccagaagcaaacuuuaaagauauagcagaccuauacuacgacuuuauagugaucaaaucacauaaaaauaugggauucuccauaaaaaagcuucgagaaaaaaugcucgaaugcgacggagcagaccgaauaaaagaacaagauauggacucaguccgaucaaaauuauacaaacuaauagauuucugcauauuuaaauacuaccacgaauucccagaacuaucagaaaaaaauguagacauauuaagagcugcagucuccgacacgaaaaaagacaaccuauacagcgaugaagcagcacgacuauggucaaucuucaaagaaaaauucuuaggauucugugacaaaauaguaguauggguaacaggagaacaugaaaaagauauaacaagcgucauagauaaagaugcauaucgaaauagaucaaacgucucuuauuucucaaaacuaauguaugcuaugugcuuuuuucucgacggcaaggaaaucaaugaucuuuuaacaacuuuaaucaauaaauuugacaauauagcaaaccaaauaaagacugcaaaagaacuaggaauaaacacugcauuuguuaaaaauuaugauuuuuuuaaucauagcgaaaaauauguagaugaacuuaauauaguaaaaaacauagcaagaaugaaaaaaccaucaucaaaugcaaaaaaagcuauguaccacgacgcacuaacgauacucggaauaccagaagacauggacgaaaaagcgcuugacgaagaauuagaccuaauauuagaaaagaaaaccgacccaguaaccggaaaaccacucaaaggcaaaaauccacuacgcaacuuuauagccaacaacguaaucgaaaauuccagauucauauaccucauuaaauucugcaacccagaaaacguaagaaaaauaguaaacaacacaaaaguaaccgaauucguccuaaaacguauaccagacgcccaaauagaacgcuauuauaaaucauguacagacucugaaaugaaccccccaacagaaaaaaaaauaacugaacucgcagguaagcuaaaagauaugaauuucggaaauuuuagaaaugucagacaaagcgccaaagaaaacauggaaaaagaaagauucaaagccguuauaggacuauaccuaacaguagucuauagagugguuaaaaacuuagucgauguaaacucacgauacaucauggcauuucauucuuuagaaagagacucacaacuauauaacguaagugucgacaaugauuauuuagcacugacagauacacuaguuaaagaaggugacaacagcagaucaagauaccuagccggaaauaaaagacuccgggacugugucaaacaagacaucgacaacgcaaaaaagugguuugucucagacaaauauaacucaauuacaaaauauagaaauaauguagcucaccuaacagccguaagaaauugcgccgaauucauuggagacauuaccaaaauagacucauauuucgcauuguaccauuacuuaauacaaagacaacuagcaaaaggccucgaucaugaaagaucaggauuugaccgaaauuacccacaauaugcaccauuauucaaauggcacaccuaugugaaagauguuguaaaagcacuuaacgcacccuuugguuauaacaucccaagauuuaaaaaccuuucaauagacgcacuauucgaucgaaacgaaauaaaaaaaaacgacggagaaaaaaaauccgaugacuauccuuaugacgugccagacuacgcuuga

SEQ ID NO: 14506 - RNA, 2901 nt, Artificial Sequence
  Cas13d variant__Ruminococcus flavefaciens FD1__NLS-RffCas13d-NLS-HA
augucuccaaaaaaaaaaaggaaaguagaagcuucaaaaaaaaaaaugagucuaagagaaaaaagagaggccgaaaaacaagcaaaaaaagcggcauacucagcugcaagcaaaaauacagauucaaaaccagcagaaaaaaaagccgaaacccccaaaccagcagaaaucauaucagauaauaguagaaacaaaacagcaguaaaagccgccggauugaaaucaacaauaauaaguggugacaaacuauauaugacaagcuuuggcaaagggaacgcggcagucauagaacaaaaaaucgauauaaacgauuacagcuucagcgcgaugaaagauacaccaucauuagaaguagauaaagcagaaucuaaagaaauaaguuucagcucacaucacccauucguuaaaaacgauaaacucacaacuuauaauccucuauacggaggaaaagacaaccccgaaaaaccaguaggaagagauaugcugggucuaaaagacaaacuagaagaaagauauuucggcuguacauucaaugauaaccuccauauacaaauaauuuauaacauauuagacauagaaaagauucuagccguccacucagccaacaucacaaccgcacucgaccacaugguagaugaagaugacgaaaaauaccuaaacucggacuauaucggauacaugaacaccauuaauacauacgacgucuuuauggauccuagcaaaaacucuagcuuaagcccaaaagacagaaaaaauaucgacaacagcagagcuaaauucgaaaaacucuuaucuacuaaaagacugggauacuucgguuucgauuaugaugccaacggcaaagacaaaaaaaaaaacgaagaaauaaaaaaaagacucuaccaccugacagcauuugcaggacaacucaggcaguggucauuccacagugcaggaaauuacccacgcacauggcuauacaaacuagacagccucgauaaagaauaucuagacaccuuagaucacuacuucgauaaaagauuuaacgacauaaacgacgacuuuguaacaaaaaacgcuacaaauuuauauauacuaaaagaaguauuccccgaagccaauuuuaaagauaucgccgauuuguacuacgacuucauaguaaucaaaucacacaaaaacaugggauucucaauuaaaaaacuacgagaaaagauguuagagugugacggagcagaucgaaucaaggagcaagauauggacucaguacgaucaaaacucuacaaacuaaucgacuucugcauauucaaauacuaucaugaauucccagaacucucagagaaaaauguagacauccuaagggccgcaguaucugacacuaaaaaagacaacuuauacucugacgaagccgcacgauuauggucaauauuuaaagagaaauuccuaggcuucugcgauaaaauaguagucuggguaacaggagaacaugaaaaagauauaacuucaguaauagauaaagacgcauauagaaaccgaagcaacgucucauauuuuaguaaauuaauguacgcaauguguuucuuucuggacggcaaagaaauaaacgauuuacuaacaacucuaauuaauaaauucgacaacauagccaaccaaauaaaaacagcaaaagaacuagguauaaauacagcuuucguaaaaaacuaugacuuuuuuaaccacagugaaaaguaugucgaugaacucaauauagucaaaaacauagcaaggaugaaaaaacccaguucaaaugccaaaaaagcaauguaucacgacgcacugacaauacuuggaauacccgaagacauggaugaaaaagcucuagacgaagaacuagaccuaauacuagaaaagaaaacagauccaguuacaggaaaacccuuaaaaggaaaaaacccauugaggaacuuuauagcaaacaaugucauugaaaacucaagauucauauaucucaucaaauucuguaauccugaaaaugucagaaaaauagucaauaacacuaaaguaaccgaauucguucuaaaaagaaucccagacgcacaaauagaaagauauuacaaaucauguacagacagcgaaaugaacccaccgacggaaaaaaaaauaacagaacuugcuggcaaacuuaaagauaugaauuucggaaacuuccgcaauguaagacaaucagccaaagaaaauauggagaaagaacgguuuaaagccguaauaggacuauacuuaaccguuguauacaggguaguaaaaaaccuuguugauguaaacaguagauauauaauggcauuucacuccuuagaacgagacagccaacuauacaauguaucaguagacaacgacuaccuagcucugacagacacacuaguaaaagaaggagauaacucacgauccagguaccuagcaggaaauaaacgacucagagauugcguaaaacaagacauagacaacgcuaaaaaaugguuuguaagcgauaaauauaacucaauaacaaaauaucgaaauaacgucgcacaccuaacagcaguacgaaauugcgcagaauucauaggagauaucacaaaaauagacagcuauuucgccuuauaccacuaccuaauacagcgacaauuagcuaaaggauuagaccaugaacgaaguggauucgauagaaacuacccacaauaugcuccccucuucaaauggcauaccuacgugaaagacgucguuaaagccuuaaaugcaccauucggauacaauauuccuagauuuaaaaaucuaucaauagaugccuuauucgauagaaacgaaauuaaaaaaaacgacggcgaaaaaaaaucagacgacggaagcggcccaaaaaagaaacgaaaagucgcagcagcauacccauaugacguaccagauuaugcuuga

SEQ ID NO: 14507 - RNA, 2931 nt, Artificial Sequence
  Cas13d variant__Ruminococcus flavefaciens XPD3002__RfxCas13d-HA
augauagaaaaaaaaaaaagcuucgcaaaagggauggguguaaagucuacacuaguaucaggaaguaagguauacaugaccacauucgcugaaggcucagaugcaagauuagaaaaaaucguagaaggagauucaauaagaaguguuaaugaaggagaagcauucucugcagaaauggcugauaaaaacgccggcuacaaaauagguaaugcaaaguuuucccacccaaaaggcuaugcuguaguagcaaauaacccacuauacacaggcccuguacagcaagacaugcuagguuuaaaagaaacacuagaaaagagauauuuuggagaaagcgcugacggaaaugacaacauuuguauacaaguuauacacaauauacuagacauagaaaaaauucuagccgaauauaucaccaacgccgcauacgcuguaaacaacauaaguggauuagacaaagacauaauaggauucggaaaauucuccacaguauacacguaugaugaauuuaaagauccagaacaucauagagccgcuuucaacaacaacgauaagcuaauaaaugcuauaaaagcccaauacgacgaauucgauaacuuccuagacaaccccagacuaggauacuuuggacaagcauucuucagcaaagaaggcagaaacuauaucauaaacuauggcaacgaaugcuacgacauauuagcguuauuaaguggcuuaagacacuggguaguucauaauaacgaagaagaaagcagaaucucgagaacaugguuauacaaccuugauaaaaacuuagauaacgaauacauaaguacauuaaacuaccuuuacgacagaauuacaaaugaacugacaaauaguuucaguaaaaauagcgcagcaaacguaaacuacauagcagagacacuaggaauuaacccagcagaauuugcagaacaauacuuccgauucaguauaaugaaagagcaaaaaaacuugggauuuaacauuacaaaacuacgagaaguaaugcuagaccgaaaagacaugucugaaauacguaaaaaccacaaaguauucgacucaaucaggacaaaaguauacacaaugauggacuucguuauauauagauacuauauugaagaagaugcaaaaguugcagccgcaaauaaaagccuaccagauaacgaaaaaaguuuaagcgaaaaagauauauuugucauaaaccuuagaggaucauuuaaugaugaccaaaaagacgcacucuauuaugacgaagcuaaucgaauauggaggaaauuagaaaauauaaugcauaacauaaaagaauuuagaggaaacaaaacgagagaauauaaaaaaaaagacgcaccaaggcuacccagaauauuaccagcaggcagagauguaagcgcauuuucuaaacuuauguaugcccuaaccauguuuuuagacggaaaagaaauuaacgaucuauuaacaacacucaucaauaaauucgauaacauacaaucauuucuaaaaguaaugccacuuauuggaguaaaugcaaaauucguagaagaauaugcauucuuuaaagacucagcaaaaauugcagaugaacuaagauugaucaaaucuuucgcgagaaugggagagccuauagcugacgccagacgugcaauguacauagacgcaauacgaauccuaggaacaaauuuaagcuacgaugaacuaaaagcgcuagcagacacauucucacuagacgaaaacggaaacaaauuaaagaaaggcaaacacgggaugagaaacuuuauaauaaauaauguaauaagcaacaaaagauuccauuaucuuauaagauacggagauccggcucaucuacaugaaauagcaaaaaacgaagcaguagucaaauucgugcuaggucgaauagcagacauacagaaaaaacaaggacaaaacggcaagaaucaaauagacagauauuaugaaacaugcauaggcaaagauaaaggaaaaagcguaucagaaaaagucgaugcacuaaccaaaaucauaaccggaaugaacuacgaccaauucgacaaaaaaagaucagucauagaagacacaggacgagaaaaugcagaaagagaaaaauuuaaaaaaauaauaucacucuacuuaacgguaauauaccacauacuaaaaaacauuguuaacaucaacgccagguauguaauagguuuccauuguguagaaagagacgcgcaacuauauaaagaaaaaggauaugacaucaacuuaaaaaaguuagaagaaaaaggauuuagcucagugacaaaauuaugugccggaauagaugagacagcaccagauaaaagaaaggaugucgaaaaagaaauggcagaacgcgcaaaagaaaguauagacucacuugaaagcgcaaauccaaaacuauacgcaaauuauauaaaauacuccgaugaaaaaaaagcagaagaauucacgcgacagauaaacagagaaaaagcaaagacagcacuuaacgccuaccuaagaaauacuaaguggaacguaauuauaagggaagaucuacuucgcauugauaacaaaacauguacacucuuuagaaacaaagcaguccaucuagaagucgcaagauauguacacgcguacauaaacgauauugcagaaguuaauagcuauuuucaacucuaccauuacaucaugcaaagaauaauaaugaaugaaagauaugaaaaguccuccggaaaaguaagcgaauacuuugacgcagucaaugaugaaaagaaauauaacgacagacuacuaaaacuucuaugcguaccauucggauauuguauaccaagauuuaaaaacuuaaguaucgaagcacucuucgacagaaaugaagcagcaaaauucgauaaagaaaaaaaaaaaguaagcggaaacucauauccauacgauguucccgacuacgcauga

SEQ ID NO: 14508 - RNA, 2931 nt, Artificial Sequence
  Cas13d variant__Ruminococcus flavefaciens XPD3002__dRfxCas13d-HA
augauagagaaaaagaaaaguuuugcaaaaggaauggggguaaagaguacacuagugagcggcagcaaaguauauaugaccacguuugcagaaggaucugacgcacgguuagagaaaauaguagaaggagauagcauaagaucaguaaacgaaggcgaggcauuuagcgccgaaauggccgacaaaaacgccggcuacaaaauugguaacgcgaaauucucacauccaaaagguuaugcgguaguagcuaacaauccacuauauaccggaccgguccaacaagacauguuaggauuaaaagaaacacuagaaaaacgauacuuuggagaaucggcagacgguaaugacaauauauguauacaaguaauccauaauauucucgacauagaaaaaauacuagccgaauacauuacaaacgccgccuaugcaguaaauaacauaagcggccuagauaaagacauaauagguuucgguaaauuuucaacaguauauacuuacgacgaauucaaagauccagaacaccauagagcggcauucaacaauaacgacaaauuaaucaaugcaauaaaagcacaauacgacgaauucgauaauuuucucgacaauccgagauuaggauacuuuggacaagcuuuuuuuagcaaagaaggcaggaacuacauaauaaacuaugguaaugaaugcuaugauauauuagcacuuuuaaguggacuagcacauuggguagucgcaaauaaugaggaagaaaguagaauaucacguacaugguuauauaaccuagauaaaaaccuagauaaugaauacauuaguacuuuaaacuaucuauacgaccgaauuacaaacgaacuaaccaacucauuuuccaaaaacuccgcagcaaauguaaauuacauagcagaaacccuaggaauaaacccagcugaauucgcugaacaauauuucagguuuagcauaaugaaagaacaaaaaaacuuaggauuuaauauaacuaaacucagagagguuaugcuagacagaaaagacaugucagaaauaagaaagaaucauaaaguauucgacaguaucagaacaaaaguauauacaaugauggacuucguaauauauagauacuacauugaagaagacgcuaaaguugcagcagcuaacaaaucacucccagacaacgaaaaaucucugagugaaaaagacauauucguaauaaacuuaagagguucauuuaacgaugaccaaaaagacgcucuguacuacgaugaagcuaaccgaauauggcguaaauuagaaaacauaaugcacaacauaaaagaauucaggggaaacaaaacaagagaauacaaaaaaaaagacgcccccaggcuaccuagaauacuccccgcaggcagagaugucagugcguuuucaaaauuaauguaugcacucacaauguuucuugacggaaaagaaauaaacgaccugcugacaacacuaauaaauaaauucgauaauauacaaagcuuccuaaaaguaaugccauuaauaggaguaaacgcaaaguuuguugaagaauaugccuuuuucaaagauucagcaaaaaucgcagacgaacuaagacuaauaaaaucauucgcacguaugggagaaccgauagcugacgcacgacgcgcaauguacauagacgccauaagaauauuagggacaaaucuaucauacgacgaauuaaaagcauuagcagauacauuuucacuagacgaaaauggaaauaaguuaaaaaaagguaaacauggcaugagaaacuuuaucauaaauaauguuauuuccaacaaaagauuucacuauuugauaagguauggagauccagcacauuuacaugaaaucgcuaaaaacgaagcaguuguaaaauucguccuuggaagaauagcagauauacaaaaaaaacaaggucaaaacgguaaaaaccaaauagacagauacuaugaaacaugcaucggaaaagacaaaggcaaaucagugucugaaaaaguagacgcauuaaccaaaauaauaacuggaaugaauuacgaucaauucgauaaaaagagaagcguaauagaagacacaggaagagaaaaugccgaaagagagaaguucaaaaaaauaauaucacuauaucuuacgguaaucuaccacaucuuaaaaaauauaguaaauauaaaugccagguauguaauaggauuccacugcgucgaacgugacgcccaacuguacaaggaaaaaggauacgacauaaauuuaaaaaaauuagaagaaaaaggguucaguucaguuacaaaacuuugugccgguauagacgagacagcgccagauaaaagaaaagacguagaaaaagaaauggcagaacgcgccaaagaaagcauagauagcuuagaaucggccaauccuaaacucuaugccaacuacauuaaauacucagacgaaaagaaagcagaagaguucacaaggcaaauaaacagagaaaaagccaaaacagcucucaacgcuuaccuaagaaacacaaaauggaacguuaucauacgagaagaccuguuaagaauagacaauaaaacaugcacucuuuuugcaaacaaagcaguagcgcuagaaguugcaagauauguacacgccuauaucaaugacaucgccgaaguaaauagcuauuuucagcuauaucacuacauuaugcaaagaauuauaaugaacgagcguuacgaaaaaucaucaggaaaaguuucagaauauuucgaugcaguaaacgaugaaaaaaaauacaacgauagacuauuaaaauuacucugcguaccauuuggcuauuguauuccaagauuuaagaaccuaaguauagaagcacuauucgaucgcaaugaagccgcaaaguuugauaaagaaaaaaaaaaagucaguggaaacaguuacccuuaugacguaccugacuacgcauga

SEQ ID NO: 14509 - RNA, 3003 nt, Artificial Sequence
  Cas13d variant__Ruminococcus flavefaciens XPD3002__NLS-RfxCas13d-NLS-HA (CasRx)
augucacccaaaaaaaaaagaaaaguagaagccaguauagaaaaaaaaaaaucauuugcgaaaggaaugggaguaaagucuacucuagucucaggaagcaaagucuauaugacaacauucgcagaggggagcgaugccagacucgaaaagauuguagaaggagauaguaucagaucaguaaacgaaggagaagcauuuuccgccgaaauggccgauaaaaaugcaggauauaaaauuggcaaugcaaaauucucacacccaaaaggcuaugcaguagucgcaaacaacccuuuauacaccgguccaguacaacaagauaugcuaggacuaaaggaaacacuagaaaagagauauuucggagaaucagccgauggcaacgacaauauauguauacaagucauccauaacauauuagacauagaaaaaauacuagccgaauacauuaccaacgcagccuacgcaguaaauaacaucucaggucuagauaaggacauaauaggauuuggcaaauuuagcacaguuuauacauacgaugaguucaaagaccccgagcaccaccgagccgcauuuaauaacaaugacaaauuaauaaacgccaucaaagcacaauacgacgaauuugacaacuuccuugacaauccccgacuaggguacuucggacaagcuuucuuuagcaaggaaggccgcaauuauauuaucaacuacggaaacgaaugcuaugacauauuagcccucuuaucuggauuaagacacugggucguacauaacaacgaagaggaaucaagaauaucacgaacauggcuguacaaucuagauaaaaaucuagacaacgaguacauaucaacacuuaacuaccuauaugaccgcauaacaaaugaacuaacuaauucguucucaaaaaauucugcagcaaacguaaauuacauagccgaaacauuaggaauaaauccagcagaauucgcagaacaauauuucagauucagcauaaugaaagaacaaaaaaauuuaggauucaacauaacaaaacugagagaaguuaugcuagauaggaaagauaugagcgaaauaagaaaaaaccauaaaguauucgacucaauaagaacaaaaguuuauacaaugauggacuucguaauauauagauacuacauagaagaagacgcgaaaguagcagcugcaaacaaaucacuaccagacaaugaaaaaucauuaagugaaaaggauauauuuguaauaaaucuaaggggaucauucaaugacgaucaaaaagaugcauuauacuaugaugaagcaaaccgaauauggagaaaauuagaaaauauaaugcacaacauaaaagaauuucguggcaacaaaaccagagaauacaaaaaaaaagacgcuccaagacuaccaagaauacuaccagccggaagagauguuagugcguucucaaaacuaauguacgcucucacaauguuccuagaugguaaagaaaucaaugaccuguuaacaacguuaauaaacaaauuugauaacauacaaucauucuugaaaguuaugccauuaauaggcguaaaugcaaaauucguagaagaauacgcuuucuucaaagauucagccaagauugcagaugaauuaagacucauaaaaucauucgcaagaaugggagaaccaauagcugacgcaagaagagcuauguacaucgaugcaaucagaauuuuaggcacaaaucuaucauacgaugaauuaaaagcacuugcagauacauucucacucgaugaaaauggcaacaaacugaaaaaggggaagcaugguaugagaaauuuuaucauaaacaauguaauuaguaauaaaagauuccauuaccuaauaagauacggagaccccgcacaucuacacgaaauagcaaaaaacgaagcaguagugaaguucguauuaggaagaauagcggacauucaaaagaaacaaggccaaaacgguaaaaaccaaauagacagauauuacgaaacaugcaucggaaaagacaaaggaaaaucagucagugaaaaagucgacgcucuaacaaaaauaauaacaggaaugaauuacgaccaauucgacaaaaaaaggucuguaauagaagacaccggaagagaaaaugcagaacgugaaaaauucaaaaagauaauaagccuuuauuuaacaguaauauaccacauauuaaaaaauauuguaaacauaaacgcaagguacgugauagguuuccauugcguugagagggacgcacaacuauacaaagagaaaggauacgauauaaaucugaaaaaacuagaagaaaaagguuucucaagugucaccaaauuaugcgcaggaauagacgaaacagcaccagacaaaagaaaagauguagaaaaagaaauggcagaaagggcaaaggaaagcauagacucucuagaaucagcuaacccaaaacuuuaugcgaacuacauaaaauauagcgacgaaaagaaagccgaggaauuuacgagacaaauuaacagagaaaaagcaaaaacagcacuaaaugcuuaucucagaaacacaaaauggaauguaauaauacgagaagauuuacuacgaaucgauaacaaaacaugcacacucuuuagaaacaaagcaguccauuuagaaguagcuagguauguacaugcauacauaaacgacauagcugaaguuaauagcuauuuccaacuauaccacuacaucaugcaacgaaucauaaugaacgaaagauacgaaaagucaaguggaaaaguaagugaauacuuugaugcaguaaacgacgaaaaaaaauauaacgauagacuccuaaaauuacuauguguuccuuuuggcuauugcauuccaagauuuaaaaacuuaucaauagaagcuuuauuugaucgaaacgaagcugcaaaauucgauaaagaaaaaaaaaagguaucaggaaacucaggaaguggaccaaaaaaaaaacguaagguugcagcggcauauccauaugauguuccagacuacgcguga

SEQ ID NO: 14510 - RNA, 3003 nt, Artificial Sequence
  Cas13d variant__Ruminococcus flavefaciens XPD3002__NLS-dRfxCas13d-NLS-HA (dCasRx)
augaguccuaaaaagaaacgaaaaguagaagcguccauagagaaaaagaaaucuuucgcuaaaggaaugggaguaaaaaguacacuggucucaggaucaaaagucuauaugaccacauucgccgaaggaucugaugcccgacucgagaaaauaguagaaggugauucuauaagaaguguaaaugaaggagaagcauucagugcagaaauggcagauaaaaacgcaggguacaaaauaggaaacgcaaaauuuagccacccaaaaggcuacgcuguagucgcuaacaacccccuauacacaggaccaguacaacaagacaugcuaggacugaaagaaacacuagaaaaacgauacuucggugaaucugcagauggaaacgauaacauuuguauacaaguaauccacaacaucuuagauauagagaaaauauuagcagaauacauaacgaacgcagcuuaugccguaaauaacauaucaggacuugacaaagacauaauuggcuuuggaaaauuuucgacagucuacaccuacgacgaauuuaaagacccggaacaccaucgggcagcauucaauaauaacgauaaacuaauaaacgcuauaaaagcacaauacgaugaauuugacaacuuccuagauaacccaagacuaggauauuuuggacaagcauucuuuucaaaagaaggaagaaauuauaucauaaacuauggaaacgaauguuaugacauacuagcauuacuaaguggacuagcacauuggguaguugccaacaacgaagaagaaucucgaauaucacgaacaugguuauacaaucuagauaaaaacuuagauaaugaauauauaaguacguugaacuacuuauacgauagaaucacaaacgaauuaacaaauagcuucagcaaaaacucagcagcaaacgucaauuacauagcagaaacacuaggaauaaauccagcagaauuugcagaacaauacuucagauucaguauaaugaaagaacagaaaaaucugggguuuaacauaacaaaauugcgugaagucauguuagaucggaaagacaugucagaaaucaggaaaaaccauaaaguauucgacucaaucagaacaaaagucuacacaaugauggacuuuguaauauauagauacuacauagaagaagacgcaaaaguugcagcagcuaacaaaucacuaccagacaacgaaaaaucucuaucagaaaaagacauauuuguaaucaacuugagggguaguuucaacgacgaucaaaaagacgcauuauauuacgaugaagccaacagaauauggagaaaacuggaaaacaucaugcauaacaucaaagaguucagaggaaacaaaacuagagaauacaaaaagaaagacgcaccaagauuaccacgcauauuaccagcuggaagggauguaucugcuuucaguaaacucauguacgccuuaaccauguuucuagacggcaaagaaauuaacgauuuauuaacuacucuaauaaacaaauuugacaauauucagagcuucuugaaagugaugccucuuaucggaguaaacgcaaaauucguugaagaauaugccuucuuuaaagauucagccaaaauagcagacgaauugagacuaauaaaaucauucgcacgcaugggagaacccauagcagaugccagacgcgcaauguacauugaugcaauaagaauuuuaggaacaaacuugucauaugacgaacuaaaagcccucgcagacacauuuucucuagaugaaaauggcaacaaacucaagaaaggaaaacacggaaugcgaaauuucauaauuaauaacguuauaagcaauaaaagguuccauuaucuuauaagauacggugacccagcacauuugcaugaaauagccaaaaacgaagcaguagucaaauuuguacucgguagaauagcagacauacaaaagaaacaaggucaaaacgggaaaaaccaaauagauagguacuaugaaaccuguaucggaaaagacaaaggaaaaagcguaucugaaaaaguugaugcuuuaacaaaaauaauaacaggaaugaauuaugaccaauucgacaagaaaagaucugucauagaagacacagggagagaaaacgcagaaagagaaaaauucaagaaaauaauaucacuauaucuaacugucauuuaucauauacucaaaaauauaguaaauaucaaugcacgauauguuauuggauuccacugcguagaaagagaugcgcaacuauacaaagaaaaaggauaugacaucaaucucaagaaacucgaagaaaaaggauucucaucagucacaaaauuaugcgcuggaauagaugaaacagccccagauaaacgaaaagauguagaaaaagaaauggcggaacgggcuaaagaaagcauagacucacuggaaucggcaaacccaaaauuauaugcaaacuauauaaaauacagugacgaaaagaaagcggaagaguucacgagacaaauaaacagagaaaaagcaaaaaccgcguuaaaugcauaccugagaaacacuaaauggaauguaauaauaagagaagaccuacuaagaauugacaacaaaacaugcacacuauuugcaaauaaagccguagcccuagaaguagcacgauauguucaugccuacauaaaugacaucgcagaaguaaacucauauuuucaauuauaucauuauaucaugcaacguauuauaaugaaugagcgauacgagaaaucaagcggaaaaguuagugaauacuucgacgcaguaaaugacgagaagaaauacaaugauagacuacuaaaacuacuaugcguacccuuuggcuacuguauucccagauucaagaauuuaucuauugaagcauuauuugaccgaaacgaagcggcaaaauucgacaaagagaaaaagaaagucagugggaacucaggcucaggccccaaaaagaaacguaaaguugcagcugcuuauccauaugauguaccggauuaugcauga

SEQ ID NO: 14511 - RNA, 3381 nt, Artificial Sequence
  Cas13d variant__Ruminococcus flavefaciens XPD3002__hnRNPa1-dCasRx-HA
auggggagaaguggaagcggaaacuuuggggguggaagaggagggggauucggaggaaaugauaacuuuggcagaggcggaaacuucagcggacgaggaggguuugggggaucucgcgguggaggaggauauggaggaucaggagauggcuacaauggauucgggaacgaugguagcaacuuuggugguggugguaguuauaacgacuucgggaacuacaacaaucaaucaagcaauuuugguccuaugaaaggaggaaauuucggaggaagaagcaguggaccguauggaggaggcggucaauacuucgccaaaccaagaaaucaaggaggguacggagguucaucaucaaguaguucuuacgguagugguagaagauuuucacccaagaagaaaagaaaagucgaagcgaguauugaaaagaagaaaaguuuugcaaaaggaaugggaguaaaaucaaccuuaguaucagguucaaaaguguacaugacaacauucgcagaaggaucagaugcuagauuagagaaaauuguagaaggagacucaauuagaaguguaaaugaaggcgaagcauuuagugcagaaauggcggauaaaaaugcaggauacaaaauaggaaacgcgaaauucucacauccaaaaggauaugcuguuguagcaaacaauccuuuauauacugggccaguacaacaagacaugcuuggauuaaaagaaacacuagagaaaagauacuucggagaaagcgcggacgggaacgauaauauauguauacaaguaauucauaacauccuagauauagagaaaauauuagcagaauauauuacaaacgccgccuaugcaguaaauaauauaucaggauuagauaaagacauaauagguuuugguaaauuuagcacaguuuauacauaugaugaauuuaaagauccagaacaucauagagcggcuuuuaacaauaacgacaaauuaauaaaugccauuaaagcacaauaugaugaauuugacaauuucuuagauaacccuagacuaggauauuuuggucaagcauucuuuucuaaagaaggaaggaacuauauaauaaacuacgguaacgaauguuacgacauucuagcuuuauuaucaggacuagcacacugggugguugcgaacaaugaagaagaaucgcgaauaagucggacuugguuauauaaccucgacaaaaauuuagacaaugaauauauaucaaccuuaaacuaccuuuacgauagaauaacaaacgaguugacaaacucauucaguaaaaauucagcagccaauguaaauuauauagccgaaacacuagguauaaauccagcagaauuugccgaacaauauuuuagauuuucaaucaugaaagaacagaaaaauuuggguuuuaauauaacuaaacuaagagaagucauguuagacagaaaagauaugucagaaauaaggaaaaaucauaaaguauuugacucgauuagaacaaaaguauauacaaugauggauuuuguaauuuaucgguauuauauagaagaagacgcaaaagucgcagccgcgaauaaaucacuaccagauaaugagaaaucacuaagugaaaaagacauauuugucauuaaccuaagaggaaguuucaacgaugaccaaaaagacgcacuauauuacgaugaagcaaaucgaauauggagaaaacuagaaaacauaaugcacaauauaaaagaauuuagaggaaacaaaacaagggaauacaaaaagaaagaugcgccuagacugcccagaauauuaccggcaggacgagaugugagcgcuuucucgaaacuaauguaugcauuaacuauguuuuuagaugguaaagaaauaaaugaucuauuaaccacauuaauaaacaaauucgauaauauacaaucauuucuaaaaguaaugccccugauugguguaaaugccaaauuuguagaagaauaugcguucuucaaagauagugcuaaaauagccgaugaacuaagacuaauaaagagcuuugcacgaaugggagaaccaauagcagacgcaaggagagcaauguauauagacgcgauacgaauacuaggaacaaacuuguccuaugacgaacucaaagcgcuagcagauacauucuccuuagaugaaaauggcaauaaauuaaagaaagguaaacaugggaugagaaauuucauuaucaacaacguaauaaguaauaaaagauuucauuaccuaauaagauauggagauccagcacaccuacaugaaauagcuaaaaaugaagcaguaguaaaauucguucuaggucggaucgccgauauacagaagaaacaaggacaaaacggcaaaaaccaaauagauagauacuacgaaacaugcauaggaaaagacaaaggcaaaaguguaucggagaaaguagaugcucuaacaaaaauaauaacaggaaugaauuaugaucaauucgacaagaaaagaaguguaauagaagauacaggcagagaaaaugcagaaagagaaaaauucaagaaaauaauuagccuguaucugacagugaucuaccauauacucaaaaacauagucaacaucaacgcaagauacgucauaggauuccacugcgucgaacgagaugcacaauuauacaaagaaaaaggauaugauauaaaccuuaagaaacuagaagaaaaaggauucucuaguguuacaaaacuaugugcaggaaucgaugaaacagcaccugauaaaagaaaagacguagaaaaagaaauggcagaaagggccaaagaaucaauugauucacuagaaucugcaaaccccaaacucuacgcgaauuauauaaaauauucagacgagaagaaagcugaagaguucacacgucaaauuaaucgugaaaaagcaaaaaccgcacuaaaugccuauuuaaggaacacaaaauggaauguaauuauuagagaagauuuacucaggauugacaauaaaacuugcacacuuuuugcaaacaaagcagucgcauuagaaguugcacgauacgugcaugcauauauaaaugauauagcagaaguaaacucguacuuccaacuauaucacuauauaaugcaacgcauuauuaugaacgaacgguaugaaaaaucguccggaaaaguaucugaauacuuugaugcaguaaacgacgaaaagaaauauaaugacagacuccuaaaacuucuaugcguuccauuuggauacugcauaccaagauuuaaaaauuuaucaauagaagcacuuuuugauagaaaugaagcagcaaaauuugacaaagaaaagaagaaaguaaguggaaacucaggcaguggaccuaaaaagaagaggaaaguugccgcagcguauccauacgauguaccagauuaugcauga

SEQ ID NO: 14512 - RNA, 2787 nt, Artificial Sequence
  Cas13d variant__Uncultured Ruminococcus sp. __UrCas13d-HA
auggccaagaaaaacaaaaugaaaccuagagaacuaagagaagcacaaaagaaagcaagacaacuaaaagcagcagaaauaaacaacaaugcugcacccgcuaucgcagcaaugccagcugcugaaguuauagcaccagcggcagagaaaaagaaaucuuccguaaaagcagcaggaaugaaaagcauacugguaucugaaaacaaaauguauauuacgucauuuggaaaaggaaacucagcagugcuagaauacgaaguagauaacaaugacuauaaucaaacacaauuaucaaguaaagacaacucgaauauccaacuaggaggugugaacgaagucaacauuacuuuuagcuccaaacauggauucgaaaguggugucgaaaucaacacuuccaauccaacccaucgaagcggcgaaagcucaccgguaagaggagacaugcuaggcuuaaaaucagaauuagaaaaacgauucuucggaaaaacauucgacgacaauauacacauccaauuaauauauaauauucuagauauugagaaaauacuagcagucuaugucacaaauauagucuaugcacugaacaacaugcuuggaguaaaaggaucagaaucacaugaugauuuuaucggauaccuaucuacuaacaauauauaugacguguucaucgacccagauaauaguaguuuaucagacgacaagaaagcaaacgucagaaaaucauugucaaaauuuaacgcacuacuaaaaacaaaaagauuaggauauuuuggacuagaagaaccaaaaacuaaagacaacagaguaagccaagcauacaagaaaagaguauaucacaugcuggcaauuguagggcaaauaagacaaugugucuuucacgacaaaaguggugcaaaaagauucgacuuauacucauuuauaaauaacauugacccugaauacagagacacauuggacuaucuagucgaagaacgauugaaaagcauaaacaaagauuucauagaagacaauaaaguuaauauaagucuacuuauagacaugaugaaaggauacgaagcugaugacauuauaagacuauacuacgauuuuauaguauuaaaaucacagaaaaaucuaggauucaguaucaagaaauuaagagagaaaaugcuagacgaauacggcuucagauucaaagacaaacaauaugauucaguacguucaaaaauguacaaacucauggauuuucuuuuguucugcaauuauuauagaaacgauauagcagccggcgaaagccuaguaagaaaauuacgcuucucaaugacagacgacgaaaaagaagguauauaugcagacgaagcagcaaaauuauggggcaaauuuagaaacgauuucgaaaacaucgcagaccauaugaacggagacgucauaaaagaacuaggaaaagcagauauggauuucgacgagaaaauacuagacucugaaaagaaaaaugcauccgaccuacucuauuucucaaaaaugaucuacaugcuuacauauuucuuagauggaaaagaaaucaaugaccuauuaaccacacucauaucaaaauucgacaacauaaaagaauuucucaaaauaaugaaaucaucagcagucgauguagaaugugaacuaacagcagguuacaaacuauuuaaugacucucaacgcauaacaaacgaacuauucaucgucaaaaacauagcaucgaugaggaaaccugcagccucugcaaaauuaacaauguuuagagaugccuuaaccauccucggaauagacgacaaaauaacugacgacagaauaucaggaauacucaaauuaaaagaaaaaggcaaaggcauacacggacucaggaacuuuauaacaaacaaugucaucgaaucaagcagauuuguuuaucuaauaaaauaugcaaaugcgcaaaagauccgagaaguagccaaaaaugaaaaaguaguaauguuugugcuuggaggcauuccagacacacaaauagaaagauauuacaaaucauguguagaauuucccgacaugaacuccagcuuaggaguuaaaagguccgaacuugcaaggaugaucaaaaacauaucauucgaugauuucaaaaacguaaaacaacaagcaaaaggaagagaaaauguggcaaaagaacgagcaaaagcaguaauaggacuauaccuaacaguaauguaccuccuagugaaaaacuuaguaaauguaaacgcaagauauguaauagcgauacacuguuuagaaagagacuuuggacuguacaaagaaauaauacccgaacucgcaaguaaaaaucugaaaaaugacuauagaauacuaucacaaacccuaugcgaauuaugugacaaaucaccaaaccuauuccucaagaaaaacgaacgacuaagaaaaugcgucgaaguugauauuaacaacgcugacuccucaaugacgcgcaaauaucgaaacugcauagcucacuuaacaguaguaagagaacuaaaagaauauauaggcgacauauguacaguagauaguuacuuuucuaucuaccauuacguaaugcaacgauguaucacaaaaagggaaaaugacacaaaacaagaagagaaaauaaaauacgaagaugacuuacucaaaaaccacgguuauaccaaagacuuuguaaaagcauuaaacucaccauuuggauauaauaucccacgauuuaaaaaucuuuccauagaacaacuauucgaucgaaaugaauaccuaacagaaaaauacccauaugacguacccgacuaugcauga

SEQ ID NO: 14513 - RNA, 2787 nt, Artificial Sequence
  Cas13d variant__Uncultured Ruminococcus sp. __dUrCas13d-HA
auggccaagaaaaauaaaaugaaaccacgagaacuuagagaagcacaaaaaaaagcgagacaacuaaaagcagcagaaauaaacaacaaugccgcacccgcaauagcagccaugccagcagccgaagucauagcacccgcugcagaaaaaaaaaaaucgagcguaaaggcggccggaaugaaaucaauuuuaguaucggaaaauaaaauguacauaacaucauuuggcaaaggaaacagugcgguacuagaauaugaaguagacaacaacgacuauaaccaaacacaacucagcucaaaagacaacaguaacauacaauuaggagggguuaaugaaguaaacaucacuuucucaucaaaacacggauuugaaucaggaguagaaauaaacacgucaaacccaacacacagaucaggcgaauccuccccaguacgaggagauaugcuaggccuaaaaucagaacuagaaaaacgguucuucggcaaaacauuugaugacaauauccacauacagcuaauuuacaauauacucgauauugaaaaaauucuagcaguauauguaaccaauauuguauacgcucuaaacaacaugcuaggcgucaaaggaagcgaaagccaugaugacuuuauaggauaucuauccacaaauaacauauaugacguuuucauagauccggacaauucaaguuuaucagacgacaaaaaagccaacguaaggaaaagucuuagcaaauucaacgcauuacuaaaaacaaaaagacuuggauacuuuggauuagaagaaccgaagaccaaagacaacagagugagccaggccuacaaaaaacgaguauaccauaugcuugcuauaguaggacaaauugcacaaugcguauucgccgauaaaucaggugcaaaacgauuugauuuauacucguucauaaauaauaucgacccagaauacagagauacacuugacuauuuaguagaagaaagauuaaaaucaauaaacaaggacuucauugaagacaauaaagucaacauaaguuuacuaauagauaugaugaaaggcuaugaagcagacgauaucauaagacucuacuacgacuucauuguauuaaaaagucaaaaaaaucuaggauuuucaauaaaaaaacuaagagaaaaaaugcuagaugaauacggauuuagauucaaagauaaacaauacgacagcguuaggagcaaaauguauaaauuaauggauuuucuacuguuuugcaauuacuaucggaacgacaucgccgcaggcgaaagccucguaagaaaauuaagauucucaaugacagacgacgaaaaagaagguauauacgcagaugaagccgccaagcucuggggaaaauuucgaaacgauuuugaaaacauagcagaucauaugaauggagacguaauaaaagaacuaggcaaagcugauauggauuuugacgaaaaaauacuagacagcgaaaagaaaaacgcaagcgaccuucuauauuucagcaagaugauauauaugcuaaccuacuuccuugacggaaaagaaauaaaugauuuacuaacaacccuaauuucaaaauucgacaacauaaaagaauuuuuaaaaauaaugaaaucgagugccguagacguagaaugcgaacuaacagcaggauacaaacuuuuuaacgauucucaaagaauaaccaaugaauuauucaucguaaaaaacauagccucaaugcgaaaaccagccgcaucagcaaaacuuacaauguuucgcgacgcacuaacaauucucggaauugacgauaaaauuacagaugaccguauuuccggaauacucaaacuaaaagaaaaaggaaaaggaauucacggacuaagaaacuuuauaacuaacaaugucauagaaagcucuagauuuguuuaccuuauaaaguacgcaaaugcacaaaaaauaagagaaguugcaaaaaacgaaaaaguugugauguuuguucucggaggaauaccagacacucaaaucgaaagauauuauaaaaguugcguugaauucccagacaugaacaguucccuaggagucaaaagauccgaacucgcgagaaugauaaaaaauauaaguuuugacgacuuuaagaauguaaaacaacaagcaaaaggaagagaaaauguugcuaaggaaagagcaaaggccguaauuggauuauacuuaaccguuauguauuuacuuguaaaaaaucuaguuaacguaaaugcgagauauguaaucgcaauccacugucuagaaagggacuuugggcuauacaaggaaauaauacccgaacuagcaucaaaaaaucucaaaaaugauuacagaauauuaucacaaacauugugcgaacuaugcgauaaaagccccaaccuauuucuaaaaaaaaaugaaagacuacgaaaauguguagaagucgacauaaauaacgcagacuccucaaugacaagaaaauaugccaacugcauagcagcacuuaccguagugagagaauuaaaagaauacaucggagauauaugcaccgucgacagcuacuucucuauauaucacuauguaaugcaaagauguauaacaaagagagaaaaugacaccaaacaagaagaaaaaauuaaauacgaagacgauuuauuaaagaaccauggauacacaaaagauuucguaaaagcucuaaacucaccauucggcuacaauaucccaagauuuaaaaacuuaucaauagaacaacuauuugacagaaaugaauaccuuacagaaaaauacccuuacgauguaccagacuaugcauga

SEQ ID NO: 14514 - RNA, 2859 nt, Artificial Sequence
  Cas13d variant__Uncultured Ruminococcus sp. __NLS-UrCas13d-NLS-HA
auguccccaaaaaaaaagagaaaagucgaagcaagugcaaaaaaaaacaaaaugaagccuagagaacucagagaagcucaaaaaaaagcaagacaacuaaaagcagcagaaauuaauaauaacgcugcccccgcgauagccgcaaugccagcagcagaagucauagcaccagcagccgaaaaaaaaaaaucauccguaaaagcggcaggaaugaaaucaauccuaguaagugaaaauaaaauguauauaaccagcuuuggcaaaggaaauucagccguucuugaauaugaaguagauaacaacgacuauaaucaaacacaacugucauccaaagauaacucaaauauacagcuaggagguguaaacgaagucaauauaacauuuucguccaaacacggauuugaaagcggaguugaaauaaacaccaguaacccaacacaccgcuccggagaaucgagcccaguaaggggagauauguuaggacuaaaaucagaauuagaaaaacguuuuuuuggcaaaacuuuugaugacaacauacacauacaacucauauacaauauauuagacauugaaaaaauacuagcaguauacguaacaaauauagucuacgcauugaauaacaugcuaggaguaaaaggaucagaaucacacgaugauuucaucgguuaccugagcacaaacaacaucuaugacguauucauagauccagacaauagcucauuaucugacgauaaaaaagcaaauguaagaaaaagucuaaguaaauuuaaugcuuuacuuaaaacaaaacgacuaggauacuuuggauuagaagaaccuaagacaaaagacaaucgaguaucacaggcauauaaaaaaagaguauaucacaugcucgcaauaguuggacagauccgacaauguguauuucaugauaaaucgggagccaaaagauucgaucuauacucuuucauaaauaauauagacccagaauaccgagacacacuggacuacuugguugaagagcgauuaaaaucaauaaacaaagacuucauagaagacaauaaaguaaauauaagccuacuaaucgauaugaugaaaggauaugaagcggaugauauaauacgacuguacuacgauuucauaguacuuaaaucacaaaagaaccuaggauucucaauaaaaaaacuacgugaaaaaaugcucgacgaauacggauucagauuuaaagacaaacaauacgacagugugagaucaaaaauguacaaauuaauggauuuuuuauuauucugcaacuacuacagaaaugauauagccgcuggcgaaagucucguacggaaauuaagauuuaguaugacagaugaugaaaaagaaggaauauacgccgacgaagcagcaaaguuaugggguaaauucagaaacgauuucgaaaacaucgcggaccacaugaacggagacguaauaaaagaacugggaaaggcagauauggacuuugaugagaaaauccuagacucugaaaaaaagaaugcaagugaccuacuauacuucuccaaaaugauauacaugcuaacauacuuccucgauggaaaagaaauuaacgacuugcugacuacccuaauaucaaaauuugauaauauaaaagaauuccuuaaaauuaugaaaucuucggcaguagacguagaaugugaacuaacagcaggauacaaauuauucaacgacagucaacguauuacaaacgaauuauucauaguaaaaaauaucgcaucgaugcguaaaccagcagccagugcuaaacuaacaauguucagagacgcucuaacaauauuaggcauugaugacaaaauaacagaugauagaauuaguggaauacuaaaauuaaaggaaaaaggcaaaggaauacacgggcuacgaaacuucauaacuaacaaugucauagaaucaucaagauucguauaucucauaaaauaugcgaacgcacaaaaaaucagagaaguagcaaaaaacgaaaaaguaguuauguucguuuuaggaggaauuccugauacccaaauagaacgauauuacaaaagcugcgucgaauuuccagacaugaauucaucacuaggaguaaaaagauccgaauuagcaagaaugauuaaaaacaucagcuuugacgacuucaagaacguaaaacaacaagcaaaaggccgcgagaauguggcaaaagaaagagcuaaagcuguaauagggcuauaucucacaguuauguauuuauuaguaaaaaaucuaguaaacguaaacgcccgauauguuauagcaauacauuguuuagaacgcgacuucggauuauacaaagaaauaauaccggaguuagcaagcaaaaaccuaaaaaaugauuaccguauacucagccaaacgcuaugugaacucugcgacaaaucaccaaaucuauuuuuaaaaaaaaacgaaagacuucgaaaaugcgucgaaguagacauaaauaacgcagacucaucaaugacgcgaaaauacaggaacuguauagcccaccuaacugucguccgcgaacuaaaagaauauaucggagacauauguacaguagacucauauuuuucuauauaccauuacguaaugcaacgauguauaacaaagcgagaaaaugacaccaaacaagaagaaaaaauaaaauacgaggacgacuuacuaaaaaaccauggguacacaaaagauuucguaaaagccuuaaacaguccguucggauauaauauuccacgauucaaaaaccuaucaauagagcaacuauucgauagaaacgaauacuuaacagaaaaaggaagcggccccaaaaaaaaacgcaaaguagccgcagcuuauccuuacgacguccccgauuaugcuuga

SEQ ID NO: 14515 - RNA, 2859 nt, Artificial Sequence
  Cas13d variant__Uncultured Ruminococcus sp. __NLS-dUrCas13d-NLS-HA
auguccccaaaaaaaaagcgaaaaguagaagcgagcgcaaaaaaaaauaaaaugaaaccaagagaacuacgugaagcacaaaaaaaagcaagacaauuaaaagcugcagaaauaaacaacaaugcagccccagcuauagcagcaaugccagcagcagaaguaauagcacccgcggccgagaaaaaaaaaucaucaguaaaagcagccggcaugaaaucuauacuaguaagugaaaauaaaauguauaucacgaguuucggaaaaggaaacucggccguccuagaauacgaaguagacaacaaugacuacaaucaaacacaauuaagcagcaaagacaauuccaacauacaacuaggagguguaaacgaaguaaauauaacauucuccagcaaacauggcuucgaaucaggaguagaaauaaauacaucaaacccaacucauagaaguggagagucguccccagugagaggagauauguuaggacugaaaucagaguuagaaaaaagauucuucggaaagacuuucgaugauaacauucacauucaacuaauauauaauauccuagacauagaaaagauccuagcaguauacguaacaaacauaguauaugcauuaaacaacaugcuaggagugaaaggaucugaaucccacgacgauuuuauaggcuauuuaagcacaaauaauauauaugacgucuucauagacccagauaauaguucguuaucugacgacaaaaaagcuaauguacguaaaucacugucaaaauucaacgcacuacuaaaaaccaagagacuaggguauuucggccuugaagaaccaaaaacuaaagauaaucgaguaucucaagcauauaaaaagagaguuuaccauauguuagccauaguaggccaaauagcacaauguguguucgcggacaaaucaggugcaaaaagauucgacuuauacucauuuauuaacaauauagauccugaauaucgagacacgcuagauuaccuaguggaagaaagauuaaaaagcauaaacaaagauuuuauagaagacaacaagguaaauaucucccuacuaauagacaugaugaaaggcuaugaagcagacgacauaauacguuuauauuaugacuucauaguauuaaaaucacaaaaaaaccuaggcuucaguauaaaaaaauuacgcgaaaaaauguuagacgaauauggcuucagauucaaagacaaacaauaugauucuguuagaucaaaaauguacaaauuaauggacuuuuuacuuuucugcaacuacuacagaaaugauauagccgcgggagaaucauuaguucgaaaacuaagauucagcaugacugacgacgaaaaagaaggcauuuacgcagaugaagcugcaaaacuauggggaaaauuucgaaacgauuucgaaaauauagccgaccacaugaacggagacgucauaaaagaacuaggaaaagcagauauggauuucgaugaaaaaauacuagauucagaaaaaaaaaaugcaucagaccuucuuuacuucagcaaaaugauauauauguuaaccuauuuuuuggacggaaaagaaauaaacgaccuauuaacaacauuaauauccaaauuugauaacauaaaagaauuccuaaaaauaaugaaaaguagugccguagacguagaaugugaacuaacagcaggauauaaacuauucaaugacagccagcgcauaaccaacgaacuuuucauagucaaaaacauagcuucgaugagaaaaccagcagcuucugccaaauuaacaauguuucgagaugcacuaacuauacuuggaauagacgacaaaauaacugacgacagaauaucuggaauacuaaaacuaaaagaaaaagggaaagggauucauggccuacgaaacuucauaacaaacaacguaauagaaaguuccagauucguauaucuuauaaaauacgcgaaugcucagaaaauuagagaaguugcuaaaaacgaaaaaguaguaauguuugucuuaggagguauaccugauacccaaauagaaagguauuauaaaucauguguagaauucccagauaugaacucaucucuaggaguaaaaagaagugaacuagcaagaaugauaaaaaauauaaguuucgacgacuuuaaaaauguaaaacaacaagcaaaaggaagagaaaacguagcaaaagaacgagcaaaggccgucauaggcuuauaucuaacagucauguaucuacuaguaaaaaaccuggugaauguaaaugcacguuauguaaucgcaauacauugcuuagaaagagauuuuggcuuauauaaagaaauuauaccagaacuagccucaaaaaacuugaaaaacgauuauagaauauuaagucagacuuuaugcgaauuaugugacaaaagcccaaaccuuuucuuaaaaaaaaacgaaagacuacgaaaaugcgucgaaguagacauuaacaacgcagacucuagcaugacccguaaauacgcaaacugcauagccgcuuuaacaguugucagagaguuaaaagaauacauuggagacauuuguacaguagauucauacuuuuccauuuaccacuacguaaugcaacgauguauaacaaaaagagaaaacgauacaaaacaagaagaaaaaaucaaauaugaagaugaccugcucaaaaaccacggauauacaaaagauuucguaaaagcacuaaacucaccauuuggauauaacauaccaagauucaaaaauuuaucuauugaacaacucuucgaccgaaacgaauauuuaacagaaaaagguagcggaccuaaaaaaaaacgaaaagucgcagcggcauauccauacgacguaccagacuacgcauga

SEQ ID NO: 14516 - RNA, 4275 nt, Artificial Sequence
  Cas13d variant__Leptotrichia wadei __NLS-LwCas13a-msfGFP
augaaaagacccgcggcaacaaagaaagcgggacaagcaaaaaagaaaaaaggaagcaugaaaguaacaaaaguagacgggauaucgcacaaaaaauauauugaagaaggaaaauuaguuaaaucuacgagcgaagaaaauaggacaagcgagagacucagcgagcuacuaagcauuagacuggacauauacauaaaaaauccugacaacgcaagcgaggaggaaaauagaauaagaagagaaaaucuaaaaaaauuuuucagcaauaaaguauuacaccuaaaagacaguguauuauaucuaaaaaaucgaaaagaaaaaaaugccguacaagauaaaaacuacucugaagaggacauauccgaauaugaccuaaaaaacaagaacagcuucuccguccuaaaaaaaauacuacuaaaugaagauguuaacagugaggaacucgaaauauucagaaaagauguagaagcuaaacuaaacaaaauuaauaguuuaaaauacagcuucgaagagaauaaagccaacuaccaaaaaaucaacgaaaacaauguagaaaaaguuggcggcaaaucaaaaagaaacauaauuuacgacuauuacagagagagcgcgaaaagaaacgacuacauaaauaaugugcaagaagcauuugacaagcuauauaaaaaagaagauauagaaaaacuauucuuccuaaucgaaaacagcaaaaagcacgaaaaauacaaaauaagggaauauuaucauaaaauaauaggcagaaaaaaugauaaagaaaauuucgccaaaaucauauacgaagagauacagaauguaaauaacauaaaggaacuaaucgaaaaaauaccagacaugagugaacucaaaaaaagccaaguauucuauaaauauuaucuugacaaggaagaacuaaaugacaaaaacauaaaauaugcuuucugucauuucguagaaauagagaugucccagcuucuaaagaauuauguauacaaacgacuaagcaauauaagcaacgacaagauaaaaagaauauuugaauaccagaaccuaaaaaaacucauagaaaauaaguuacuaaacaaacuagauacauacgucagaaauugugguaaguacaacuacuacuuacaaguaggagaaauagcaacuucagauuucauagcaagaaacagacaaaacgaagcauuccucaggaacaucaucggaguuagcagcguugcauauuuuucacugaggaauauacuagagacugagaaugaaaacgggauaacaggaagaaugagagguaaaacuguaaaaaauaacaaaggagaagaaaaauaugucagcggagaaguagauaagauauacaacgaaaauaagcagaaugaaguaaaagaaaauuuaaaaauguucuauaguuacgacuucaacauggauaauaaaaaugaaauugaagacuucuucgcuaacauagacgaagcaauauccaguauaagacacggaauaguacacuucaaucucgaauuggaaggcaaagacaucuucgccuuuaaaaacauugcgccaagugaaauaaguaagaaaauguuccaaaacgaaauaaacgagaaaaaacuuaagcuaaaaauuuucaaacaauuaaauagcgcaaacguauuuaauuacuaugaaaaagauguuauuauaaaauauuuaaagaacacaaaauucaacuucgucaacaaaaauauaccauucguacccagcuuuacuaaacuauauaacaaaauagaagacuuaagaaauacucuaaaauucuuuuggucagucccaaaagacaaagaagaaaaggaugcacaaauauauuugcuaaaaaacauauauuauggagaauuucucaauaaauuugugaaaaauagcaaaguuuucuucaaaauaaccaaugaaguaaucaaaaucaacaaacagagaaaccaaaaaaccggacacuauaaguaccaaaaauucgaaaacauugaaaaaaccgucccuguagaguacuuagcuauaauacaaucaagagaaaugaucaauaaccaggacaaagaagagaaaaacacuuacauagauuuuauucaacaaaucuuccuaaaaggcuucaucgacuauuuaaacaaaaauaaccuaaaauauaucgaaaguaacaacaacaaugauaacaacgacaucuuuucaaaaaucaagaucaaaaaagacaauaaagaaaaguaugauaaaauucuaaaaaacuacgagaaacauaaccguaacaaggaaauuccucacgaaauaaacgaauucgugcgagaaauaaaauuaggaaaaauacuaaaauacaccgaaaaccuuaauauguucuaccuuauacuaaaauuauugaaccauaaagaacuuaccaaucucaaaggaucuuuagaaaaauaccaaucagccaacaaagaagaaacauucucggaugaacuugaacuaauaaauuuauuaaauuuagauaauaacagggucacagaagacuucgagcuggaagcaaaugaaauaggcaaauuccucgauuucaaugagaauaaaauaaaagaccgcaaggaauuaaaaaaauuugacaccaauaaaauuuacuucgacggcgaaaauauaauuaagcacagagcauuuuauaacauaaaaaaauauggcauguuaaacuugcuagaaaaaaucgcagacaaggcaaaguacaaaauaagccuaaaggaauuaaaagaauacaguaacaaaaagaacgagauagaaaaaaacuacacaaugcaacaaaaccuccaucgaaaauacgcacggccgaaaaaagaugaaaaauuuaacgaugaagacuacaaagaauacgaaaaagcaauuggcaauauacaaaaauacacacaucuaaaaaauaaaguagaauucaacgaacuuaaucuauuacaaggacuacuacuaaaaauucuacaucggcuaguaggguauaccaguauaugggaaagggacuuacgcuuucgauugaaaggagaauuucccgagaaccauuacauagaagaaaucuucaauuuugacaauaguaaaaacguaaaauauaaaucaggccaaauaguagaaaaauacaucaacuucuacaaagaacuauauaaagauaacguagaaaaacgcucaaucuauagcgacaaaaaagucaagaaauuaaaacaagaaaaaaaagaucuauacauccgcaauuacauagcacauuuuaacuauauaccucacgcggagauaucauuacuagaaguauuggaaaaucuaagaaaauuacucaguuacgacagaaaacuaaaaaaugcaauaaugaaaucuauaguagauauuuuaaaagaauacggcuucguagcaacauuuaaaaucggagccgacaaaaagauagaaauucaaacguuagaauccgaaaaaaucguacacuuaaaaaauuugaaaaaaaaaaagcuaaugaccgacaggaacagugaagaacugugugaauuagucaaaguaauguuugaauacaaagcgcuagaaggaggaggagguaguggcgguggaggaaguggaggaggaggaagcguaucaaaaggagaagaacuauucacgggaguaguuccaauucuaguggaguuagacggugacgucaaugggcacaaguuuucaguuagaggagaaggagagggagacgcaaccaacggcaaguuaacacucaaauucauauguacaacagggaagcuacccgucccauggccaacacucguaacuacccugacauacggaguccaauguuuuuccagauauccugaccacaugaaacaacacgacuucuucaaaagugcaaugccagaaggcuauguccaagaacgaacaauaucuuuuaaagaugacgguacauauaaaacaagagcggaaguaaaauuugaaggggacacacuaguuaaucgaauagaacucaaaggaaucgauuucaaggaagacggcaacauacugggccauaaauuggaauauaauuuuaacagccacaacgucuacaucacggcagacaaacagaaaaacggcaucaaagccaacuucaaaauaagacacaauguagaagacggaagcguucaguuagcugaccacuaccaacagaacacaccuaucggcgaugggcccguauuacuaccggacaaucacuaccuauccacgcaaucaaaauuaagcaaagacccuaaugaaaaacgugaccacauggucuuacuagaauuuguaacagcggcaggaauaacauuagguauggacgagcuguacaaauga

SEQ ID NO: 14517 - RNA, 4275 nt, Artificial Sequence
  Cas13d variant__Leptotrichia wadei __NLS-dLwCas13a-msfGFP
augaaaagaccggccgccaccaagaaagccggccaagcuaaaaagaagaaaggauccaugaaaguaacaaaaguggaugguauaucucauaagaaauauauagaagagggcaaacugguaaaaaguacuucugaagaaaacagaacaagugaacgacugagugaauuauuaucaauacgacuagauauauacaucaaaaauccagacaacgcaucugaagaagaaaauagaauaagaagagaaaaucucaagaaauucuuuucuaacaaaguucuacacuugaaagauucuguacuuuacuuaaagaauaggaaagagaaaaacgcagugcaagauaaaaauuacucggaagaagauauaagugaauaugaucuaaagaauaaaaacagcuucucaguauuaaagaaaauacuauuaaaugaagacguaaacucugaagaauuggaaauuuuucgcaaagacguagaagcaaaauuaaacaaaauaaauucuuuaaaauauaguuuugaagaaaacaaagcuaauuaccagaaaauaaaugaaaacaauguggaaaaaguuggcggcaaaucuaaacggaacaucauauacgauuacuaucgagaaucagcaaaaaggaaugauuauaucaacaauguacaagaagcauuugauaaauuauauaagaaagaagacauugaaaaacuauuuuuccuuaucgaaaauagcaagaaacacgaaaaauauaaaauuagagaauacuaucacaaaauaauaggaagaaagaacgauaaagaaaauuuugcaaaaauaauauacgaagaaauacaaaacguaaacaacauaaaagaauuaaucgagaaaauaccagacaugucagaacuaaagaaaucacaaguauuuuauaaauacuaccucgacaaagaagaauuaaaugacaaaaacaucaaauaugcauuuugccacuuugucgaaauagagaugagccaauuacuaaagaacuacguauacaaacgauuaaguaauauauccaaugacaaaaucaaaaggaucuucgaauaccaaaacuuaaagaaauuaauagaaaauaaauuauuaaacaaauuagacacuuaugugcguaacugcggcaaauauaacuauuaucuucaaguuggagaaauagcaacaagugauuucaucgcccguaacagacaaaaugaagccuuuuuaagaaauauaaucggcguuucaucaguagccuauuuuucccuaagaaauauccuagaaacagaaaacgaaaaugguaucacuggaaggaugcgcggaaaaaccgucaaaaauaauaaaggugaagaaaaauauguaucaggcgaaguagacaaaauauacaacgaaaauaaacaaaaugaaguuaaagaaaaccuaaaaauguuuuacucauacgauuucaauauggacaacaaaaaugaaauagaagacuucuucgccaauauagaugaagccauaucuucuaucgcacauggcauaguacauuucaaccuagaacuagaaggaaaagauauauucgcauucaaaaacauagcuccaucagaaaucagcaagaaaauguuccaaaacgaaauaaacgagaagaaacuaaaauugaaaaucuuuaaacagcuaaacagugccaacguauuuaacuacuacgaaaaagacguuauaauaaaauaucucaaaaacacaaaauuuaacuucguaaacaaaaacauaccauucguaccaaguuucacuaaauuauacaacaaaaucgaagaucuacgcaauacauuaaaauucuuuuggagcguaccaaaagacaaagaagaaaaagacgcccaaauauaccuacuuaaaaauauauauuacggagaguuccuaaacaaauuugucaaaaacagcaaaguauucuuuaaaauuacaaaugaagucauaaaaauaaauaaacaaaggaaccagaaaacaggucacuacaaauaucaaaaauucgaaaauauagagaaaacagugcccguugaauaucuagcaauaauacaaucacgggaaaugauaaacaaccaagacaaagaagagaaaaacacauauauagacuuuauacaacaaauauuccuaaaaggauucauagacuaucuaaacaaaaacaacuuaaaauacauugaaaguaacaacaacaaugacaacaacgauauauucucgaaaaucaaaaucaagaaagacaauaaagaaaaauaugauaaaaucuuaaagaacuacgaaaaacacaaccgaaauaaagaaauaccacaugagauaaaugaguucguaagagaaauaaaguuaggaaaaauacuaaaguacacggaaaaccugaacauguucuaccugauacuaaaauuguuaaaucacaaagaacuaacaaauuuaaaggguucauuagaaaaauaccaaagcgcgaacaaagaagaaaccuucucagacgaauuagaauuaauuaaucuucuaaaucuagacaacaacagggugacagaagauuucgaacuugaagcaaaugaaaucggaaaauuuuuagacuucaaugaaaauaagaucaaagauagaaaagaguuaaagaaauucgacacaaauaaaauauacuucgauggggagaauauaauaaaacaccgugcauucuacaacaucaagaaauacggaaugcuaaacuuauuagagaaaauugccgacaaagccaaauacaaaauaucacuaaaagaauuaaaagaauauuccaacaagaagaaugaaauagagaaaaacuacacaaugcagcaaaacuuacacagaaaauacgcucgacccaagaaagacgaaaaauucaaugaugaagacuauaaagaauaugagaaggcuauaggaaacauucaaaaguacacucacuuaaagaacaaaguagaguucaacgaacuaaauuuacuacaaggacuauuacucaaaauccuacacagauuaguaggcuauaccagcauuugggaacgcgaucuaagauuuagauuaaaaggagaguucccugaaaaccacuauaucgaggaaauauuuaacuucgacaacagcaaaaacguaaaauauaaaucgggacaaaucguagaaaaauauauaaacuucuacaaagagcuguauaaagacaacguugagaaaaggucaauauacucagauaaaaagguaaagaaauuaaaacaagaaaagaaagaucuuuauaucgcgaacuauauagcccacuuuaacuacauaccccaugccgaaauauccuuauuggaaguacucgaaaauuuacguaaacuacuuaguuaugaccggaaacugaaaaaugcuauaaugaaaagcauagucgacauccuaaaagaauauggauucguggcgacauucaaaauaggagcagacaagaaaauagaaauacaaacacuagaguccgagaaaauaguucaucucaaaaaccuaaagaagaagaaauuaaugacagaucggaacucagaagaacuaugcgaauuagucaaaguaauguuugaauacaaagcauuagaaggagggggcgguucaggaggaggugguagugguggcggaggaagcguaucuaaaggcgaagaacuuuucacaggaguagugccuauauuaguagaacuagacggagacguaaauggacauaaauucucgguacggggugaaggagaaggcgaugcaacaaacggaaaacuaacuuuaaaauuuaucugcacuacaggaaaacuaccaguacccuggcccacuuuaguuacaacacuaaccuauggcguucagugcuucucaagauacccugaccacaugaaacaacacgacuuuuucaaaucagcaaugcccgaaggauauguacaagaacggacgauuuccuuuaaagaugauggaaccuacaaaacuagagcagaaguaaaauuugaaggugacacucuuguuaaucgaauagaauuaaaagggauugacuuuaaagaagacggaaauauacuaggucauaaauuagaauacaacuuuaauagccacaaugucuauaucacagcagacaaacagaaaaacgguaucaaagccaacuuuaaaauucggcauaacguugaagacggaagcguacaauuagcagaccacuaccaacaaaauacaccaauuggcgacggaccaguacuacucccugacaaucacuaucuauccacacagucaaaacucaguaaagaucccaaugaaaagcgagaccacauggugcuauuagaguucguaaccgcugcaggaauaacauuagguauggaugaauuauauaaauga

SEQ ID NO: 14518 - RNA, 4203 nt, Artificial Sequence
  Cas9 mRNA product
auggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguga

SEQ ID NO: 14519 - RNA, 4203 nt, Artificial Sequence
  Cas9 mRNA product
auggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaaguga

SEQ ID NO: 14520 - RNA, 4203 nt, Artificial Sequence
  Cas9 mRNA product
auggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaaguga

SEQ ID NO: 14521 - RNA, 4813 nt, Artificial Sequence
  Cas9 mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14522 - RNA, 4593 nt, Artificial Sequence
  Cas9 mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 14523 - RNA, 4420 nt, Artificial Sequence
  Cas9 mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 14524 - RNA, 4716 nt, Artificial Sequence
  Cas9 mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14525 - RNA, 4542 nt, Artificial Sequence
  Cas9 mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14526 - RNA, 4708 nt, Artificial Sequence
  Cas9 mRNA product
gggagacuuucccauucuguagcagaauuugguguugccuguggucuuggucccgcggagaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14527 - RNA, 4488 nt, Artificial Sequence
  Cas9 mRNA product
gggagacuuucccauucuguagcagaauuugguguugccuguggucuuggucccgcggagaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14528 - RNA, 4813 nt, Artificial Sequence
  Cas9 mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14529 - RNA, 4593 nt, Artificial Sequence
  Cas9 mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 14530 - RNA, 4420 nt, Artificial Sequence
  Cas9 mRNA product
gggagagucccgcagucggcguccagcggcucugcuuguucgugugugugucguugcaggccuuauucaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 14531 - RNA, 4716 nt, Artificial Sequence
  Cas9 mRNA product
gggagagucccgcagucggcguccagcggcucugcuuguucgugugugugucguugcaggccuuauucaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14532 - RNA, 4542 nt, Artificial Sequence
  Cas9 mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14533 - RNA, 4708 nt, Artificial Sequence
  Cas9 mRNA product
gggagacuuucccauucuguagcagaauuugguguugccuguggucuuggucccgcggagaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14534 - RNA, 4488 nt, Artificial Sequence
  Cas9 mRNA product
gggagacuuucccauucuguagcagaauuugguguugccuguggucuuggucccgcggagaagcuuaccauggcccccaagaagaagcgcaaggucggcauccacggcguccccgccgccgacaagaaguacuccaucggccucgacaucggcaccaacuccgucggcugggccgucaucaccgacgaguacaagguccccuccaagaaguucaagguccucggcaacaccgaccgccacuccaucaagaagaaccucaucggcgcccuccucuucgacuccggcgagaccgccgaggccacccgccucaagcgcaccgcccgccgccgcuacacccgccgcaagaaccgcaucugcuaccuccaggagaucuucuccaacgagauggccaaggucgacgacuccuucuuccaccgccucgaggaguccuuccucgucgaggaggacaagaagcacgagcgccaccccaucuucggcaacaucgucgacgaggucgccuaccacgagaaguaccccaccaucuaccaccuccgcaagaagcucgucgacuccaccgacaaggccgaccuccgccucaucuaccucgcccucgcccacaugaucaaguuccgcggccacuuccucaucgagggcgaccucaaccccgacaacuccgacgucgacaagcucuucauccagcucguccagaccuacaaccagcucuucgaggagaaccccaucaacgccuccggcgucgacgccaaggccauccucuccgcccgccucuccaagucccgccgccucgagaaccucaucgcccagcuccccggcgagaagaagaacggccucuucggcaaccucaucgcccucucccucggccucacccccaacuucaaguccaacuucgaccucgccgaggacgccaagcuccagcucuccaaggacaccuacgacgacgaccucgacaaccuccucgcccagaucggcgaccaguacgccgaccucuuccucgccgccaagaaccucuccgacgccauccuccucuccgacauccuccgcgucaacaccgagaucaccaaggccccccucuccgccuccaugaucaagcgcuacgacgagcaccaccaggaccucacccuccucaaggcccucguccgccagcagcuccccgagaaguacaaggagaucuucuucgaccaguccaagaacggcuacgccggcuacaucgacggcggcgccucccaggaggaguucuacaaguucaucaagcccauccucgagaagauggacggcaccgaggagcuccucgucaagcucaaccgcgaggaccuccuccgcaagcagcgcaccuucgacaacggcuccaucccccaccagauccaccucggcgagcuccacgccauccuccgccgccaggaggacuucuaccccuuccucaaggacaaccgcgagaagaucgagaagauccucaccuuccgcauccccuacuacgucggcccccucgcccgcggcaacucccgcuucgccuggaugacccgcaaguccgaggagaccaucacccccuggaacuucgaggaggucgucgacaagggcgccuccgcccaguccuucaucgagcgcaugaccaacuucgacaagaaccuccccaacgagaagguccuccccaagcacucccuccucuacgaguacuucaccgucuacaacgagcucaccaaggucaaguacgucaccgagggcaugcgcaagcccgccuuccucuccggcgagcagaagaaggccaucgucgaccuccucuucaagaccaaccgcaaggucaccgucaagcagcucaaggaggacuacuucaagaagaucgagugcuucgacuccgucgagaucuccggcgucgaggaccgcuucaacgccucccucggcaccuaccacgaccuccucaagaucaucaaggacaaggacuuccucgacaacgaggagaacgaggacauccucgaggacaucguccucacccucacccucuucgaggaccgcgagaugaucgaggagcgccucaagaccuacgcccaccucuucgacgacaaggucaugaagcagcucaagcgccgccgcuacaccggcuggggccgccucucccgcaagcucaucaacggcauccgcgacaagcaguccggcaagaccauccucgacuuccucaaguccgacggcuucgccaaccgcaacuucaugcagcucauccacgacgacucccucaccuucaaggaggacauccagaaggcccaggucuccggccagggcgacucccuccacgagcacaucgccaaccucgccggcucccccgccaucaagaagggcauccuccagaccgucaaggucgucgacgagcucgucaaggucaugggccgccacaagcccgagaacaucgucaucgagauggcccgcgagaaccagaccacccagaagggccagaagaacucccgcgagcgcaugaagcgcaucgaggagggcaucaaggagcucggcucccagauccucaaggagcaccccgucgagaacacccagcuccagaacgagaagcucuaccucuacuaccuccagaacggccgcgacauguacgucgaccaggagcucgacaucaaccgccucuccgacuacgacgucgaccacaucgucccccaguccuuccucaaggacgacuccaucgacaacaagguccucacccgcuccgacaagaaccgcggcaaguccgacaacguccccuccgaggaggucgucaagaagaugaagaacuacuggcgccagcuccucaacgccaagcucaucacccagcgcaaguucgacaaccucaccaaggccgagcgcggcggccucuccgagcucgacaaggccggcuucaucaagcgccagcucgucgagacccgccagaucaccaagcacgucgcccagauccucgacucccgcaugaacaccaaguacgacgagaacgacaagcucauccgcgaggucaaggucaucacccucaaguccaagcucgucuccgacuuccgcaaggacuuccaguucuacaagguccgcgagaucaacaacuaccaccacgcccacgacgccuaccucaacgccgucgucggcaccgcccucaucaagaaguaccccaagcucgaguccgaguucgucuacggcgacuacaaggucuacgacguccgcaagaugaucgccaaguccgagcaggagaucggcaaggccaccgccaaguacuucuucuacuccaacaucaugaacuucuucaagaccgagaucacccucgccaacggcgagauccgcaagcgcccccucaucgagaccaacggcgagaccggcgagaucgucugggacaagggccgcgacuucgccaccguccgcaagguccucuccaugccccaggucaacaucgucaagaagaccgagguccagaccggcggcuucuccaaggaguccauccuccccaagcgcaacuccgacaagcucaucgcccgcaagaaggacugggaccccaagaaguacggcggcuucgacucccccaccgucgccuacuccguccucgucgucgccaaggucgagaagggcaaguccaagaagcucaaguccgucaaggagcuccucggcaucaccaucauggagcgcuccuccuucgagaagaaccccaucgacuuccucgaggccaagggcuacaaggaggucaagaaggaccucaucaucaagcuccccaaguacucccucuucgagcucgagaacggccgcaagcgcaugcucgccuccgccggcgagcuccagaagggcaacgagcucgcccuccccuccaaguacgucaacuuccucuaccucgccucccacuacgagaagcucaagggcucccccgaggacaacgagcagaagcagcucuucgucgagcagcacaagcacuaccucgacgagaucaucgagcagaucuccgaguucuccaagcgcgucauccucgccgacgccaaccucgacaagguccucuccgccuacaacaagcaccgcgacaagcccauccgcgagcaggccgagaacaucauccaccucuucacccucaccaaccucggcgcccccgccgccuucaaguacuucgacaccaccaucgaccgcaagcgcuacaccuccaccaaggagguccucgacgccacccucauccaccaguccaucaccggccucuacgagacccgcaucgaccucucccagcucggcggcgacaagcgccccgccgccaccaagaaggccggccaggccaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14535 - RNA, 4813 nt, Artificial Sequence
  Cas9 mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14536 - RNA, 4593 nt, Artificial Sequence
  Cas9 mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 14537 - RNA, 4420 nt, Artificial Sequence
  Cas9 mRNA product
gggagagucccgcagucggcguccagcggcucugcuuguucgugugugugucguugcaggccuuauucaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 14538 - RNA, 4716 nt, Artificial Sequence
  Cas9 mRNA product
gggagagucccgcagucggcguccagcggcucugcuuguucgugugugugucguugcaggccuuauucaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14539 - RNA, 4542 nt, Artificial Sequence
  Cas9 mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14540 - RNA, 4708 nt, Artificial Sequence
  Cas9 mRNA product
gggagacuuucccauucuguagcagaauuugguguugccuguggucuuggucccgcggagaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14541 - RNA, 4488 nt, Artificial Sequence
  Cas9 mRNA product
gggagacuuucccauucuguagcagaauuugguguugccuguggucuuggucccgcggagaagcuuaccauggcccccaagaagaagcgcaaagugggaauccacggggugcccgcggcugacaagaaguacagcaucggccuggacaucgggaccaacucagugggcugggccguaaucaccgacgaauacaaaguccccucuaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggagaaagaaccggaucuguuaccugcaggagaucuucuccaacgagauggccaagguggacgacagcuucuuccaccgccucgaggagagcuuccuggucgaggaggacaagaagcacgagcggcaccccauuuucgggaacauuguggacgaaguggcguaccacgagaaguaccccaccaucuaccaccuucgcaagaagcucgucgacagcaccgacaaggccgaccugagacugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccucuggcguugacgccaaagccauccuguccgcgagacuuagcaagucucgcaggcucgagaaccugaucgcccagcuucccggggagaagaagaacggccuauucggcaaccugauugcccugagccucggacugacacccaacuucaaguccaacuucgaucuggccgaggaugcgaaacuccaguugucuaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacugguuaagcugaaccgggaggaccugcucagaaagcagcgcaccuucgacaaugggagcaucccccaccagauccaccugggcgagcugcacgcgauccucagacgccaggaggacuucuaccccuuccugaaggacaaccgggagaagaucgagaagauccucaccuuucggauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugcccaacgagaaggugcugcccaagcacucccuccuguacgaguacuucacgguguauaacgaacucaccaagguuaaguacgugaccgaggggaugcggaagcccgcuuuccucagcggcgagcagaagaaggccaucguggacuugcuguucaagaccaacagaaaggucacggugaagcagcucaaggaggauuacuucaagaagaucgagugcuucgacuccguugagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcguagacgcuacaccggguggggcagacucagcagaaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcucgggagaaccagaccacccagaaggggcagaagaacucccgcgagagaaugaagagaaucgaggagggcaucaaggagcuggggagccagauccugaaagagcaccccguggagaacacccagcuccagaacgagaagcucuaccuguacuaccuucagaacggccgggauauguacguugaccaggagcuggacauuaacaggcugagcgacuaugacguggaccacaucgugccccaguccuuccucaaagacgacagcaucgacaacaagguccugacacgguccgacaagaacagaggcaagagcgacaacgugcccuccgaggagguagucaagaaaaugaaaaacuauuggagacagcugcucaacgcuaagcugaucacccagcgcaaauucgacaacuugaccaaagccgaacgcgggggccucucugagcuagacaaggccggguucaucaagagacagcugguggagacccggcagaucaccaagcacguagcccagauccucgacuccaggaugaacacgaaguacgacgagaacgacaaacugaucagagaggucaaggugaucacccucaagagcaaacuugugagcgacuucagaaaggacuuccaguucuauaagguuagggagaucaacaacuaccaccacgcgcacgacgcauaccugaacgccguggugggcaccgcccugaucaagaaguacccgaaacuugagagcgaguucguuuacggggacuacaagguguacgacgugagaaagaugaucgcgaaguccgagcaggagaucggaaaggccaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggagagacuucgccacggugagaaaggugcucuccaugccccaggucaauaucguaaagaagaccgaggugcagaccggcggguucagcaaggaguccauccugcccaagcgcaacagcgauaaguuaaucgcgcguaagaaggacugggaccccaagaaguacggcggcuucgacucccccaccgucgcuuacagcgugcugguggucgcgaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccagcgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagucuaucacgggccuguacgagacccgcaucgaucucagccagcucgggggcgauaagcggcccgccgccaccaagaaggccgggcaggcgaagaagaagaagugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14542 - RNA, 4593 nt, Artificial Sequence
  Cas9 mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 14543 - RNA, 4716 nt, Artificial Sequence; identical to SEQ ID NO: 413
  Cas9 mRNA product

SEQ ID NO: 14544 - RNA, 4542 nt, Artificial Sequence
  Cas9 mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 14545 - RNA, 4708 nt, Artificial Sequence
  Cas9 mRNA product
gggagacuuucccauucuguagcagaauuugguguugccuguggucuuggucccgcggagaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14546 - RNA, 4488 nt, Artificial Sequence
  Cas9 mRNA product
gggagacuuucccauucuguagcagaauuugguguugccuguggucuuggucccgcggagaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu
